US011752181B2

(12) United States Patent
Sah et al.

(10) Patent No.: US 11,752,181 B2
(45) Date of Patent: *Sep. 12, 2023

(54) COMPOSITIONS AND METHODS OF TREATING HUNTINGTON'S DISEASE

(71) Applicant: VOYAGER THERAPEUTICS, INC., Cambridge, MA (US)

(72) Inventors: Dinah Wen-Yee Sah, Hopkinton, MA (US); Fen Chen, Saugus, MA (US); Pengcheng Zhou, Lexington, MA (US); Xin Wang, Arlington, MA (US); Yanqun Shu, Winchester, MA (US); Jinzhao Hou, Lexington, MA (US); Jochen Deckert, Bayreuth (DE); Markus Hossbach, Kulmbach (DE)

(73) Assignee: VOYAGER THERAPEUTICS, INC., Cambridge, MA (US)

( * ) Notice: Subject to any disclaimer, the term of this patent is extended or adjusted under 35 U.S.C. 154(b) by 719 days.

This patent is subject to a terminal disclaimer.

(21) Appl. No.: 16/611,041

(22) PCT Filed: May 4, 2018

(86) PCT No.: PCT/US2018/031117
§ 371 (c)(1),
(2) Date: Nov. 5, 2019

(87) PCT Pub. No.: WO2018/204803
PCT Pub. Date: Nov. 8, 2018

(65) Prior Publication Data
US 2020/0155624 A1 May 21, 2020

Related U.S. Application Data

(60) Provisional application No. 62/520,086, filed on Jun. 15, 2017, provisional application No. 62/507,921, filed on May 18, 2017, provisional application No. 62/501,786, filed on May 5, 2017.

(51) Int. Cl.
*A61K 35/76* (2015.01)
*C12N 15/113* (2010.01)
*A61P 25/14* (2006.01)
*C12N 7/00* (2006.01)
*C12N 15/86* (2006.01)
*A61K 48/00* (2006.01)

(52) U.S. Cl.
CPC .............. *A61K 35/76* (2013.01); *A61P 25/14* (2018.01); *C12N 7/00* (2013.01); *C12N 15/113* (2013.01); *C12N 15/86* (2013.01); *A61K 48/00* (2013.01); *C12N 2310/141* (2013.01); *C12N 2320/32* (2013.01); *C12N 2750/14121* (2013.01); *C12N 2750/14123* (2013.01); *C12N 2750/14132* (2013.01); *C12N 2750/14143* (2013.01)

(58) Field of Classification Search
CPC .............................. A61K 35/76; C12N 15/113
See application file for complete search history.

(56) References Cited

U.S. PATENT DOCUMENTS

| | | |
|---|---|---|
| 5,064,764 A | 11/1991 | Besnainon |
| 5,474,935 A | 12/1995 | Chatterjee |
| 5,587,308 A | 12/1996 | Carter |
| 5,652,224 A | 7/1997 | Wilson |
| 5,658,785 A | 8/1997 | Johnson |
| 5,688,676 A | 11/1997 | Zhou |
| 5,691,176 A | 11/1997 | Lebkowski |
| 5,693,531 A | 12/1997 | Chiorini |
| 5,741,683 A | 4/1998 | Zhou |
| 5,756,283 A | 5/1998 | Wilson |
| 5,856,152 A | 1/1999 | Wilson |
| 5,858,351 A | 1/1999 | Podsakoff |
| 5,858,775 A | 1/1999 | Johnson |
| 5,866,552 A | 2/1999 | Wilson |
| 5,866,696 A | 2/1999 | Carter |
| 5,871,982 A | 2/1999 | Wilson |
| 5,952,221 A | 9/1999 | Kurtzman |
| 5,962,313 A | 10/1999 | Podsakoff |
| 5,989,540 A | 11/1999 | Carter |
| 6,083,716 A | 7/2000 | Wilson |
| 6,143,548 A | 11/2000 | ORiordan |
| 6,143,567 A | 11/2000 | Van Agthoven |
| 6,146,874 A | 11/2000 | Zolotukhin |
| 6,156,303 A | 12/2000 | Russell |
| 6,174,527 B1 | 1/2001 | Wilson |
| 6,180,613 B1 | 1/2001 | Kaplitt |

(Continued)

FOREIGN PATENT DOCUMENTS

| | | |
|---|---|---|
| EP | 1015619 | 7/2000 |
| EP | 1046711 | 10/2000 |

(Continued)

OTHER PUBLICATIONS

Franich et al. (2008) "AAV Vector-mediated RNAi of Mutant Huntingtin Expression Is Neuroprotective in a Novel Genetic Rat Model of Huntington's Disease" Molecular Therapy, vol. 16, No. 5, 947-956. (Year: 2008).*
International Preliminary Report on Patentability dated Nov. 7, 2019 in co-pending application No. PCT/US2018/031117, entitled Compositions and Methods of Treating Huntington's Disease.
International Search Report & Written Opinion dated Sep. 13, 2018 in co-pending application No. PCT/US2018/031117, entitled Compositions and Methods of Treating Huntington's Disease.
De Leeuw CN et al. rAAV-compatible MiniPromoters for Restricted Expression in the Brain and Eye. Mol Brain. May 10, 2016;9(1):52.
Hirsch ML, et al. Delivering Transgenic DNA Exceeding the Carrying Capacity of AAV Vectors. Methods Mol Biol. 2016;1382:21-39.

(Continued)

*Primary Examiner* — James D Schultz
*Assistant Examiner* — James Joseph Graber
(74) *Attorney, Agent, or Firm* — K&L Gates LLP

(57) ABSTRACT

The present invention relates to adeno-associated viral (AAV) particles encoding siRNA molecules and methods for treating Huntington's Disease (HD).

21 Claims, 3 Drawing Sheets

Specification includes a Sequence Listing.

(56) References Cited

U.S. PATENT DOCUMENTS

| | | |
|---|---|---|
| 6,194,191 B1 | 2/2001 | Zhang |
| 6,200,560 B1 | 3/2001 | Couto |
| 6,204,059 B1 | 3/2001 | Samulski |
| 6,211,163 B1 | 4/2001 | Podsakoff |
| 6,251,677 B1 | 6/2001 | Wilson |
| 6,258,595 B1 | 7/2001 | Gao |
| 6,261,551 B1 | 7/2001 | Wilson |
| 6,265,389 B1 | 7/2001 | Burke |
| 6,270,996 B1 | 8/2001 | Wilson |
| 6,274,354 B1 | 8/2001 | Wilson |
| 6,281,010 B1 | 8/2001 | Gao |
| 6,325,998 B1 | 12/2001 | Podsakoff |
| 6,335,011 B1 | 1/2002 | Podsakoff |
| 6,365,394 B1 | 4/2002 | Gao |
| 6,387,368 B1 | 5/2002 | Wilson |
| 6,399,385 B1 | 6/2002 | Croyle |
| 6,410,300 B1 | 6/2002 | Samulski |
| 6,416,992 B1 | 7/2002 | Mejza |
| 6,428,988 B1 | 8/2002 | Wilson |
| 6,436,392 B1 | 8/2002 | Engelhardt |
| 6,436,394 B1 | 8/2002 | Henderson |
| 6,468,524 B1 | 10/2002 | Chiorini |
| 6,468,771 B1 | 10/2002 | Einerhand |
| 6,475,769 B1 | 11/2002 | Wilson |
| 6,482,634 B1 | 11/2002 | Wilson |
| 6,485,966 B2 | 11/2002 | Gao |
| 6,503,888 B1 | 1/2003 | Kaplitt |
| 6,509,150 B1 | 1/2003 | Salvetti |
| 6,521,426 B1 | 2/2003 | Ciliberto |
| 6,555,525 B2 | 4/2003 | Burke |
| 6,566,118 B1 | 5/2003 | Atkinson |
| 6,582,692 B1 | 6/2003 | Podsakoff |
| 6,593,123 B1 | 7/2003 | Wright |
| 6,610,290 B2 | 8/2003 | Podsakoff |
| 6,642,051 B1 | 11/2003 | Lynch |
| 6,660,514 B1 | 12/2003 | Zolotukhin |
| 6,660,521 B2 | 12/2003 | Brough |
| 6,670,176 B1 | 12/2003 | Samulski |
| 6,676,935 B2 | 1/2004 | Henderson |
| 6,699,706 B1 | 3/2004 | Brooks |
| 6,710,036 B2 | 3/2004 | Kurtzman |
| 6,723,551 B2 | 4/2004 | Kotin |
| 6,726,907 B1 | 4/2004 | Zhang |
| 6,753,419 B1 | 6/2004 | Toniatti |
| 6,759,237 B1 | 7/2004 | Wilson |
| 6,846,665 B1 | 1/2005 | Horer |
| 6,855,314 B1 | 2/2005 | Chiorini |
| 6,887,463 B2 | 5/2005 | Wilson |
| 6,897,045 B2 | 5/2005 | Engelhardt |
| 6,943,019 B2 | 9/2005 | Wilson |
| 6,953,690 B1 | 10/2005 | Gao |
| 6,984,517 B1 | 1/2006 | Chiorini |
| 6,995,006 B2 | 2/2006 | Atkinson |
| 7,015,026 B2 | 3/2006 | ORiordan |
| 7,022,519 B2 | 4/2006 | Gao |
| 7,048,920 B2 | 5/2006 | Yu |
| 7,056,502 B2 | 6/2006 | Hildinger |
| 7,070,998 B2 | 7/2006 | Johnson |
| 7,091,030 B2 | 8/2006 | Setiawan |
| 7,094,604 B2 | 8/2006 | Snyder |
| 7,105,345 B2 | 9/2006 | Wilson |
| 7,112,321 B2 | 9/2006 | Wang |
| 7,125,705 B2 | 10/2006 | Colosi |
| 7,125,706 B2 | 10/2006 | Zhang |
| 7,169,612 B2 | 1/2007 | Kostenis |
| 7,186,552 B2 | 3/2007 | Wilson |
| 7,198,951 B2 | 4/2007 | Gao |
| 7,223,585 B2 | 5/2007 | Coffey |
| 7,235,393 B2 | 6/2007 | Gao |
| 7,238,526 B2 | 7/2007 | Wilson |
| 7,241,447 B1 | 7/2007 | Engelhardt |
| 7,247,472 B2 | 7/2007 | Wilson |
| 7,271,002 B2 | 9/2007 | Kotin |
| 7,282,199 B2 | 10/2007 | Gao |
| 7,291,498 B2 | 11/2007 | Roy |
| 7,300,797 B2 | 11/2007 | Van Agthoven |
| 7,306,794 B2 | 12/2007 | Wilson |
| 7,319,002 B2 | 1/2008 | Wilson |
| 7,326,555 B2 | 2/2008 | Konz |
| 7,344,872 B2 | 3/2008 | Gao |
| 7,419,817 B2 | 9/2008 | Chiorini |
| 7,419,956 B2 | 9/2008 | Ohtaki |
| 7,445,930 B2 | 11/2008 | Zhang |
| 7,479,554 B2 | 1/2009 | Chiorini |
| 7,491,508 B2 | 2/2009 | Roy |
| 7,510,872 B2 | 3/2009 | Clark |
| 7,510,875 B2 | 3/2009 | Zhang |
| 7,579,181 B2 | 8/2009 | ORiordan |
| 7,625,570 B1 | 12/2009 | Schaffer |
| 7,638,120 B2 | 12/2009 | Liu |
| 7,662,627 B2 | 2/2010 | Johnson |
| 7,704,492 B2 | 4/2010 | Podsakoff |
| 7,704,721 B2 | 4/2010 | Wright |
| 7,732,129 B1 | 6/2010 | Zhang |
| 7,790,449 B2 | 9/2010 | Gao |
| 7,803,622 B2 | 9/2010 | Engelhardt |
| 7,838,277 B2 | 11/2010 | Gao |
| 7,888,096 B2 | 2/2011 | Wu |
| 7,901,921 B2 | 3/2011 | Coffey |
| 7,906,111 B2 | 3/2011 | Wilson |
| 7,968,333 B2 | 6/2011 | Yu |
| 8,105,574 B2 | 1/2012 | Wilson |
| 8,110,351 B2 | 2/2012 | Bosnes |
| 8,137,948 B2 | 3/2012 | Qu |
| 8,163,543 B2 | 4/2012 | Urabe |
| 8,231,880 B2 | 7/2012 | Roy |
| 8,236,495 B2 | 8/2012 | Nochumson |
| 8,241,622 B2 | 8/2012 | Englehardt |
| 8,273,344 B2 | 9/2012 | Wang |
| 8,283,151 B2 | 10/2012 | Schmidt |
| 8,318,480 B2 | 11/2012 | Gao |
| 8,318,687 B2 | 11/2012 | Tabira |
| 8,394,386 B2 | 3/2013 | Wilson |
| 8,409,842 B2 | 4/2013 | Clark |
| 8,470,310 B2 | 6/2013 | Roy |
| 8,476,418 B2 | 7/2013 | Mueller |
| 8,512,981 B2 | 8/2013 | Hermens |
| 8,524,219 B2 | 9/2013 | Roy |
| 8,524,446 B2 | 9/2013 | Gao |
| 8,603,459 B2 | 12/2013 | Wilson |
| 8,614,101 B2 | 12/2013 | VanDine |
| 8,637,255 B2 | 1/2014 | Wilson |
| 8,642,314 B2 | 2/2014 | Bakker |
| 8,685,734 B2 | 4/2014 | Coffey |
| 8,697,417 B2 | 4/2014 | Bakker |
| 8,697,665 B2 | 4/2014 | Rom |
| 8,834,863 B2 | 9/2014 | Roy |
| 8,846,030 B2 | 9/2014 | Engelhardt |
| 8,846,389 B2 | 9/2014 | Chiorini |
| 8,906,387 B2 | 12/2014 | Kay |
| 8,906,675 B2 | 12/2014 | Gao |
| 8,927,514 B2 | 1/2015 | Chatterjee |
| 8,962,330 B2 | 2/2015 | Gao |
| 8,962,332 B2 | 2/2015 | Gao |
| 8,999,678 B2 | 4/2015 | Vandenberghe |
| 9,051,542 B2 | 6/2015 | Wright |
| 9,056,892 B2 | 6/2015 | Pun |
| 9,080,183 B2 | 7/2015 | Klein |
| 9,089,667 B2 | 7/2015 | Bankiewicz |
| 9,101,645 B2 | 8/2015 | Watts |
| 9,102,943 B2 | 8/2015 | Shinmura |
| 9,115,373 B2 | 8/2015 | Hermens |
| 9,163,260 B2 | 10/2015 | Wilson |
| 9,169,483 B2 | 10/2015 | Davidson |
| 9,217,155 B2 | 12/2015 | Gao |
| 9,217,159 B2 | 12/2015 | Roy |
| 9,228,174 B2 | 1/2016 | Noordman |
| 9,233,174 B2 | 1/2016 | Chen |
| 9,238,800 B2 | 1/2016 | Bossis |
| 9,260,724 B2 | 2/2016 | Bakker |
| 9,415,121 B2 | 8/2016 | Kaspar |
| 9,434,776 B2 | 9/2016 | Ando |
| 9,439,979 B2 | 9/2016 | Chiorini |
| 9,441,206 B2 | 9/2016 | Grieger |

(56) References Cited

U.S. PATENT DOCUMENTS

| | | |
|---|---|---|
| 9,441,244 B2 | 9/2016 | Schaffer |
| 9,447,433 B2 | 9/2016 | Hirsch |
| 9,457,103 B2 | 10/2016 | Schaffer |
| 9,458,517 B2 | 10/2016 | Schaffer |
| 9,464,119 B2 | 10/2016 | Sonntag |
| 9,475,845 B2 | 10/2016 | Asokan |
| 9,487,779 B2 | 11/2016 | Davidson |
| 9,493,788 B2 | 11/2016 | Gao |
| 9,499,597 B2 | 11/2016 | Miller |
| 9,506,083 B2 | 11/2016 | Arbetman |
| 9,523,093 B2 | 12/2016 | Davidson |
| 9,528,126 B2 | 12/2016 | Qu |
| 9,540,659 B2 | 1/2017 | Davidson |
| 9,546,112 B2 | 1/2017 | Voit |
| 9,546,369 B2 | 1/2017 | Gao |
| 9,567,376 B2 | 2/2017 | Cronin |
| 9,567,607 B2 | 2/2017 | Wilson |
| 9,580,691 B2 | 2/2017 | Bakker |
| 9,585,971 B2 | 3/2017 | Deverman |
| 9,587,250 B2 | 3/2017 | Gao |
| 9,587,282 B2 | 3/2017 | Schaffer |
| 9,593,346 B2 | 3/2017 | Roy |
| 9,596,835 B2 | 3/2017 | Gao |
| 9,597,363 B2 | 3/2017 | Roy |
| 9,598,468 B2 | 3/2017 | Weigel-Van Aken |
| 9,598,703 B2 | 3/2017 | Garcia |
| 9,611,302 B2 | 4/2017 | Srivastava |
| 9,617,561 B2 | 4/2017 | Roy |
| 9,623,120 B2 | 4/2017 | Chatterjee |
| 9,624,274 B2 | 4/2017 | Lux |
| 9,636,370 B2 | 5/2017 | McCown |
| 9,650,631 B2 | 5/2017 | Davidson |
| 9,670,507 B2 | 6/2017 | Xiao |
| 9,677,088 B2 | 6/2017 | Nakai |
| 9,677,089 B2 | 6/2017 | Gao |
| 9,719,106 B2 | 8/2017 | Wilson |
| 10,093,927 B2 | 10/2018 | Davidson |
| 10,174,321 B2 | 1/2019 | Konstantinova |
| 10,208,318 B2 | 2/2019 | Barkats |
| 10,570,395 B2 | 2/2020 | Hou et al. |
| 10,584,337 B2 | 3/2020 | Sah et al. |
| 11,193,129 B2 | 12/2021 | Sah et al. |
| 11,198,873 B2 | 12/2021 | Hou et al. |
| 2001/0006955 A1 | 7/2001 | Wilson |
| 2001/0049144 A1 | 12/2001 | Rivera |
| 2002/0019050 A1 | 2/2002 | Gao |
| 2002/0037867 A1 | 3/2002 | Wilson |
| 2002/0081721 A1 | 6/2002 | Allen |
| 2002/0090717 A1 | 7/2002 | Gao |
| 2002/0102714 A1 | 8/2002 | Wilson |
| 2002/0131961 A1 | 9/2002 | Wilson |
| 2003/0013189 A1 | 1/2003 | Wilson |
| 2003/0032613 A1 | 2/2003 | Gao |
| 2003/0092161 A1 | 5/2003 | Gao |
| 2003/0100115 A1 | 5/2003 | Raj |
| 2003/0119191 A1 | 6/2003 | Gao |
| 2003/0138772 A1 | 7/2003 | Gao |
| 2004/0043490 A1 | 3/2004 | Shimada |
| 2004/0057931 A1 | 3/2004 | Wilson |
| 2004/0136963 A1 | 7/2004 | Wilson |
| 2004/0171807 A1 | 9/2004 | Gao |
| 2005/0059005 A1 | 3/2005 | Tuschl |
| 2005/0255086 A1 | 11/2005 | Davidson et al. |
| 2005/0261218 A1 | 11/2005 | Esau |
| 2006/0003451 A1 | 1/2006 | Gao |
| 2006/0204479 A1 | 9/2006 | Wilson |
| 2007/0004042 A1 | 1/2007 | Gao |
| 2008/0008684 A1 | 1/2008 | Wilson |
| 2008/0015158 A1 | 1/2008 | Ichiro |
| 2008/0019946 A1* | 1/2008 | Nenoi et al. ............ A61K 48/00 424/93.2 |
| 2008/0020992 A1 | 1/2008 | Rao |
| 2008/0050343 A1 | 2/2008 | Wilson |
| 2008/0050345 A1 | 2/2008 | Wilson |
| 2008/0075737 A1 | 3/2008 | Gao |
| 2009/0118206 A1 | 5/2009 | Aronin |
| 2009/0215871 A1 | 8/2009 | Wilson |
| 2009/0275107 A1 | 11/2009 | Lock |
| 2009/0317417 A1 | 12/2009 | Vandenberghe |
| 2010/0004320 A1 | 1/2010 | Elmen |
| 2010/0036107 A1 | 2/2010 | Clawson |
| 2010/0247490 A1 | 9/2010 | Roy |
| 2010/0278791 A1 | 11/2010 | Wilson |
| 2010/0286378 A1 | 11/2010 | Li |
| 2011/0020816 A1 | 1/2011 | Chen |
| 2011/0136227 A1 | 6/2011 | Bakker |
| 2011/0171262 A1 | 7/2011 | Bakker |
| 2011/0223135 A1 | 9/2011 | Roy |
| 2011/0229971 A1 | 9/2011 | Knop |
| 2012/0046349 A1 | 2/2012 | Bell |
| 2012/0058102 A1 | 3/2012 | Wilson |
| 2012/0093853 A1 | 4/2012 | Wilson |
| 2012/0093916 A1 | 4/2012 | Kaemmerer |
| 2012/0137379 A1 | 5/2012 | Gao |
| 2012/0258046 A1 | 10/2012 | Mutzke |
| 2012/0309050 A1 | 12/2012 | Kumon |
| 2013/0023033 A1 | 1/2013 | Wilson |
| 2013/0045186 A1 | 2/2013 | Gao |
| 2013/0101558 A1 | 4/2013 | Gao |
| 2013/0195801 A1 | 8/2013 | Gao |
| 2013/0296532 A1 | 11/2013 | Hermens |
| 2013/0323226 A1 | 12/2013 | Wilson |
| 2013/0323302 A1 | 12/2013 | Constable |
| 2014/0004565 A1 | 1/2014 | Rossomando |
| 2014/0031418 A1 | 1/2014 | Wilson |
| 2014/0044680 A1 | 2/2014 | Roy |
| 2014/0065105 A1 | 3/2014 | Wilson |
| 2014/0087361 A1 | 3/2014 | Dobbelaer |
| 2014/0099666 A1 | 4/2014 | Rossomando |
| 2014/0107186 A1 | 4/2014 | Garcia |
| 2014/0336245 A1 | 11/2014 | Mingozzi |
| 2014/0341852 A1 | 11/2014 | Srivastava |
| 2014/0342434 A1 | 11/2014 | Hermens |
| 2015/0005369 A1 | 1/2015 | Muzyczka |
| 2015/0023924 A1 | 1/2015 | High |
| 2015/0065562 A1 | 3/2015 | Yazicioglu |
| 2015/0118287 A1 | 4/2015 | Hammond |
| 2015/0139952 A1 | 5/2015 | Webster |
| 2015/0152127 A1 | 6/2015 | Seinick |
| 2015/0159173 A1 | 6/2015 | Vandenberghe |
| 2015/0197751 A1 | 7/2015 | Roelvink |
| 2015/0232840 A1 | 8/2015 | Aronin |
| 2015/0238610 A1 | 8/2015 | Sista |
| 2015/0307898 A2 | 10/2015 | Hermens |
| 2015/0315610 A1 | 11/2015 | Nishie |
| 2015/0335708 A1 | 11/2015 | Froelich |
| 2015/0374803 A1 | 12/2015 | Wolfe |
| 2016/0032319 A1 | 2/2016 | Wright |
| 2016/0060624 A1 | 3/2016 | Davidson et al. |
| 2016/0108373 A1 | 4/2016 | Bennett |
| 2016/0153992 A1 | 6/2016 | Buening |
| 2016/0166709 A1 | 6/2016 | Davidson |
| 2016/0251653 A1 | 9/2016 | Davidson |
| 2016/0264994 A1 | 9/2016 | Lawrence |
| 2016/0271192 A1 | 9/2016 | Roy |
| 2016/0273058 A1 | 9/2016 | Akashika |
| 2016/0281084 A1 | 9/2016 | Davidson |
| 2016/0289275 A1 | 10/2016 | Chiorini |
| 2016/0296605 A1 | 10/2016 | Zhang |
| 2016/0296694 A1 | 10/2016 | Bankiewicz |
| 2016/0319278 A1 | 11/2016 | Khvorova |
| 2016/0331897 A1 | 11/2016 | Anand |
| 2016/0333372 A1 | 11/2016 | Srivastava |
| 2016/0333373 A1 | 11/2016 | Farley |
| 2016/0333375 A1 | 11/2016 | Chen |
| 2016/0340393 A1 | 11/2016 | Schaffer |
| 2016/0340692 A1 | 11/2016 | Wang |
| 2016/0348106 A1 | 12/2016 | Harper |
| 2016/0355808 A1 | 12/2016 | Khvorova |
| 2016/0361439 A1 | 12/2016 | Agbandje-Mckenna |
| 2016/0369298 A1 | 12/2016 | Marsic |
| 2016/0369299 A1 | 12/2016 | Boye |
| 2016/0375151 A1 | 12/2016 | Schaffer |
| 2016/0376323 A1 | 12/2016 | Schaffer |

(56) References Cited

U.S. PATENT DOCUMENTS

| | | |
|---|---|---|
| 2016/0376608 A1 | 12/2016 | Chou |
| 2017/0000904 A1 | 1/2017 | Wilson |
| 2017/0007645 A1 | 1/2017 | Handa |
| 2017/0007669 A1 | 1/2017 | Sarkar |
| 2017/0007720 A1 | 1/2017 | Boye |
| 2017/0022498 A1 | 1/2017 | Cullen |
| 2017/0028082 A1 | 2/2017 | Wilson |
| 2017/0035839 A1 | 2/2017 | Miller |
| 2017/0044504 A1 | 2/2017 | Schaffer |
| 2017/0044530 A1 | 2/2017 | Kay |
| 2017/0067028 A1 | 3/2017 | Ballon |
| 2017/0071972 A1 | 3/2017 | Buj Bello |
| 2017/0073703 A1 | 3/2017 | Chatterjee |
| 2017/0088819 A1 | 3/2017 | Vandendriessche |
| 2017/0088858 A1 | 3/2017 | Gao |
| 2017/0096460 A1 | 4/2017 | Froelich |
| 2017/0096646 A1 | 4/2017 | Roy |
| 2017/0105927 A1 | 4/2017 | Thorne |
| 2017/0112946 A1 | 4/2017 | Ikeda |
| 2017/0121734 A1 | 5/2017 | Cairns |
| 2017/0128594 A1 | 5/2017 | Wright |
| 2017/0130208 A1 | 5/2017 | Potter |
| 2017/0130245 A1 | 5/2017 | Kotin |
| 2017/0145440 A1 | 5/2017 | Hermens |
| 2017/0151348 A1 | 6/2017 | Kaspar |
| 2017/0151416 A1 | 6/2017 | Kutikov |
| 2017/0152525 A1 | 6/2017 | Hermens |
| 2017/0157267 A1 | 6/2017 | Kay |
| 2017/0159026 A1 | 6/2017 | Kay |
| 2017/0159027 A1 | 6/2017 | Wilson |
| 2017/0159072 A9 | 6/2017 | Arbeit |
| 2017/0165377 A1 | 6/2017 | Gao |
| 2017/0166871 A1 | 6/2017 | Nishie |
| 2017/0166925 A1 | 6/2017 | Gao |
| 2017/0166926 A1 | 6/2017 | Deverman |
| 2017/0166927 A1 | 6/2017 | Gao |
| 2017/0198304 A1 | 7/2017 | Wilson |
| 2017/0211092 A1 | 7/2017 | Chatterjee |
| 2017/0211093 A1 | 7/2017 | Chatterjee |
| 2017/0211094 A1 | 7/2017 | Chatterjee |
| 2017/0211095 A1 | 7/2017 | Chatterjee |
| 2017/0240921 A1 | 8/2017 | Gao |
| 2017/0298323 A1 | 10/2017 | Vandenberghe |
| 2017/0304464 A1 | 10/2017 | Kugler |
| 2017/0314028 A1 | 11/2017 | Hou et al. |
| 2018/0094264 A1* | 4/2018 | Mueller et al. ...... C12N 15/113 |
| 2018/0237772 A1 | 8/2018 | Yu |
| 2018/0298380 A1 | 10/2018 | Gao |
| 2018/0339065 A1 | 11/2018 | Wilson |
| 2019/0160091 A1* | 5/2019 | Sah et al. ............. A61K 31/713 |
| 2019/0169616 A1 | 6/2019 | Sah et al. |
| 2020/0149045 A1 | 5/2020 | Sah et al. |
| 2020/0155624 A1 | 5/2020 | Sah et al. |
| 2020/0199597 A1 | 6/2020 | Hou et al. |
| 2021/0355454 A1 | 11/2021 | Cardinal et al. |
| 2022/0127619 A1 | 4/2022 | Hou et al. |
| 2022/0162609 A1 | 5/2022 | Sah et al. |
| 2022/0275367 A1 | 9/2022 | Sah et al. |

FOREIGN PATENT DOCUMENTS

| | | |
|---|---|---|
| EP | 1078096 | 2/2001 |
| EP | 1164195 | 12/2001 |
| EP | 1183380 | 3/2002 |
| EP | 1218035 | 7/2002 |
| EP | 1240345 | 9/2002 |
| EP | 1279740 | 1/2003 |
| EP | 1453547 | 9/2004 |
| EP | 1692262 B1 | 8/2006 |
| EP | 1696036 | 8/2006 |
| EP | 1847614 | 10/2007 |
| EP | 1849872 | 10/2007 |
| EP | 1857552 | 11/2007 |
| EP | 1900815 | 3/2008 |
| EP | 1944043 | 7/2008 |
| EP | 2007795 | 12/2008 |
| EP | 2164967 | 3/2010 |
| EP | 2172549 | 4/2010 |
| EP | 2198016 | 6/2010 |
| EP | 2220241 | 8/2010 |
| EP | 2220242 | 8/2010 |
| EP | 2292779 | 3/2011 |
| EP | 2292780 | 3/2011 |
| EP | 2325298 | 5/2011 |
| EP | 2359866 | 8/2011 |
| EP | 2360251 | 8/2011 |
| EP | 2383346 | 11/2011 |
| EP | 2453735 | 5/2012 |
| EP | 2524037 | 11/2012 |
| EP | 2531604 | 12/2012 |
| EP | 2660325 | 11/2013 |
| EP | 2699270 | 2/2014 |
| EP | 2737071 | 6/2014 |
| EP | 2814958 | 12/2014 |
| EP | 2871239 | 5/2015 |
| EP | 2879719 | 6/2015 |
| EP | 2933336 | 10/2015 |
| EP | 3058959 | 8/2016 |
| EP | 3067417 | 9/2016 |
| EP | 2176283 | 11/2016 |
| EP | 3108000 | 12/2016 |
| EP | 3117005 | 1/2017 |
| EP | 3134431 | 3/2017 |
| EP | 3168298 | 5/2017 |
| EP | 3209311 | 8/2017 |
| EP | 3221456 | 9/2017 |
| EP | 3235827 | 10/2017 |
| EP | 3237618 | 11/2017 |
| WO | 1993009239 | 5/1993 |
| WO | 1995034670 | 12/1995 |
| WO | 1996017947 | 6/1996 |
| WO | 1996023810 | 8/1996 |
| WO | 1996030540 | 10/1996 |
| WO | 1998010088 | 3/1998 |
| WO | 1999027110 | 6/1999 |
| WO | 1999043360 | 9/1999 |
| WO | 1999058700 | 11/1999 |
| WO | 1999061595 | 12/1999 |
| WO | 1999060146 | 5/2000 |
| WO | 2000024916 | 5/2000 |
| WO | 2000066780 | 11/2000 |
| WO | 2000075353 | 12/2000 |
| WO | 2001014539 | 3/2001 |
| WO | 2001023001 | 4/2001 |
| WO | 2001025465 | 4/2001 |
| WO | 2001032711 | 5/2001 |
| WO | 2001036623 | 5/2001 |
| WO | 2001042444 | 6/2001 |
| WO | 2001068888 | 9/2001 |
| WO | 2001075164 A1 | 10/2001 |
| WO | 2001096587 | 12/2001 |
| WO | 2002012525 | 2/2002 |
| WO | 2002014487 | 2/2002 |
| WO | 2002020748 | 3/2002 |
| WO | 2002070719 | 9/2002 |
| WO | 2002071843 | 9/2002 |
| WO | 2003010320 | 2/2003 |
| WO | 2003024502 | 3/2003 |
| WO | 2003042397 | 5/2003 |
| WO | 2003087382 | 10/2003 |
| WO | 2003087383 | 10/2003 |
| WO | 2004027030 A2 | 4/2004 |
| WO | 2004044003 | 5/2004 |
| WO | 2004083441 | 9/2004 |
| WO | 2004108922 | 12/2004 |
| WO | 2004111248 | 12/2004 |
| WO | 2005005610 | 1/2005 |
| WO | 2005012537 | 2/2005 |
| WO | 2005111220 | 11/2005 |
| WO | 2006102072 | 9/2006 |
| WO | 2007130519 | 11/2007 |
| WO | 2007148971 | 7/2009 |
| WO | 2009134681 | 11/2009 |
| WO | 2011038187 | 3/2011 |

(56) References Cited

FOREIGN PATENT DOCUMENTS

| | | | | |
|---|---|---|---|---|
| WO | 2011054976 | 5/2011 | | |
| WO | 2011122950 | 10/2011 | | |
| WO | 2010109053 | 11/2011 | | |
| WO | 2012057363 | 5/2012 | | |
| WO | 2012114090 | 8/2012 | | |
| WO | 2012144446 | 10/2012 | | |
| WO | 2012149646 A1 | 11/2012 | | |
| WO | 2013078199 | 5/2013 | | |
| WO | 2013164793 | 11/2013 | | |
| WO | 2013170078 | 11/2013 | | |
| WO | 2014016817 A2 | 1/2014 | | |
| WO | 2014107763 A1 | 7/2014 | | |
| WO | 2014160092 | 10/2014 | | |
| WO | 2014168953 | 10/2014 | | |
| WO | 2014170470 | 10/2014 | | |
| WO | 2014170480 | 10/2014 | | |
| WO | 2014172669 | 10/2014 | | |
| WO | 2014186579 | 11/2014 | | |
| WO | 2014194132 | 12/2014 | | |
| WO | 2014201252 | 12/2014 | | |
| WO | 2015012924 | 1/2015 | | |
| WO | 2015013148 | 1/2015 | | |
| WO | 2015018503 | 2/2015 | | |
| WO | 2014186746 | 3/2015 | | |
| WO | 2015031686 | 4/2015 | | |
| WO | 2015044292 | 4/2015 | | |
| WO | 2015060722 | 4/2015 | | |
| WO | 2015084254 A1 | 6/2015 | | |
| WO | 2015106273 | 7/2015 | | |
| WO | 2015108610 | 7/2015 | | |
| WO | 2015114365 | 8/2015 | | |
| WO | 2015121501 | 8/2015 | | |
| WO | 2015124546 | 8/2015 | | |
| WO | 2015137802 | 9/2015 | | |
| WO | 2015127128 | 11/2015 | | |
| WO | 2015168666 A2 | 11/2015 | | |
| WO | 2015179525 A1 | 11/2015 | | |
| WO | 2015191508 A1 | 12/2015 | | |
| WO | 2015196179 | 12/2015 | | |
| WO | 2016019364 | 2/2016 | | |
| WO | 2016054554 | 4/2016 | | |
| WO | 2016054557 | 4/2016 | | |
| WO | 2016065001 | 4/2016 | | |
| WO | 2016073693 A2 | 5/2016 | | |
| WO | 2016077687 A1 | 5/2016 | | |
| WO | 2016077687 A1 | 5/2016 | | |
| WO | 2016077689 A1 | 5/2016 | | |
| WO | 2016077689 A1 | 5/2016 | | |
| WO | 2016081811 | 5/2016 | | |
| WO | 2016081927 | 5/2016 | | |
| WO | WO2016077689 A1 * | 5/2016 | ............ | C07H 21/02 |
| WO | 2016102664 | 6/2016 | | |
| WO | 2016109649 | 7/2016 | | |
| WO | 2016115382 | 7/2016 | | |
| WO | 2016115503 A1 | 7/2016 | | |
| WO | 2016115503 A1 | 7/2016 | | |
| WO | 2016122791 | 8/2016 | | |
| WO | 2016126857 | 8/2016 | | |
| WO | 2016130589 | 8/2016 | | |
| WO | 2016130591 | 8/2016 | | |
| WO | 2016137949 | 9/2016 | | |
| WO | 2016154055 | 9/2016 | | |
| WO | 2016154344 | 9/2016 | | |
| WO | 2016161374 | 10/2016 | | |
| WO | 2016164609 | 10/2016 | | |
| WO | 2016168728 | 10/2016 | | |
| WO | 2016172008 | 10/2016 | | |
| WO | 2016172155 | 10/2016 | | |
| WO | WO2016172155 A9 * | 10/2016 | ............ | A61K 35/76 |
| WO | 2016179496 | 11/2016 | | |
| WO | 2016183297 | 11/2016 | | |
| WO | 2016191418 | 12/2016 | | |
| WO | 2016196507 | 12/2016 | | |
| WO | 2017004514 | 1/2017 | | |
| WO | 2017005806 | 1/2017 | | |
| WO | 2017015102 | 1/2017 | | |
| WO | 2017019876 | 2/2017 | | |
| WO | 2017019994 | 2/2017 | | |
| WO | 2017024111 | 2/2017 | | |
| WO | 2017058892 | 4/2017 | | |
| WO | 2017062983 | 4/2017 | | |
| WO | 2017070476 | 4/2017 | | |
| WO | 2017070516 | 4/2017 | | |
| WO | 2017070525 | 4/2017 | | |
| WO | 2017070678 | 4/2017 | | |
| WO | 2017075335 | 5/2017 | | |
| WO | 2017075335 A1 | 5/2017 | | |
| WO | 2017083423 | 5/2017 | | |
| WO | 2017093330 | 6/2017 | | |
| WO | 2017096039 | 6/2017 | | |
| WO | 2017100671 | 6/2017 | | |
| WO | 2017100674 | 6/2017 | | |
| WO | 2017100676 | 6/2017 | | |
| WO | 2017100704 | 6/2017 | | |
| WO | 2017106236 | 6/2017 | | |
| WO | 2017136536 | 8/2017 | | |
| WO | 2017155973 | 9/2017 | | |
| WO | 2017161273 | 9/2017 | | |
| WO | 2017189963 A1 | 11/2017 | | |
| WO | 2017192699 | 11/2017 | | |
| WO | 2017192750 | 11/2017 | | |
| WO | 2017201248 A1 | 11/2017 | | |
| WO | 2018057855 A1 | 3/2018 | | |
| WO | 2018204803 A1 | 11/2018 | | |
| WO | 2018220211 A1 | 12/2018 | | |
| WO | 2019043027 A1 | 3/2019 | | |
| WO | 2019060726 A1 | 3/2019 | | |
| WO | 2019079240 A1 | 4/2019 | | |
| WO | 2020023612 A1 | 1/2020 | | |

OTHER PUBLICATIONS

Lu J, et al. A 5'non-coding exon containing engineered intron enhances transgene expression from recombinant AAV vectors in vivo. Hum Gene Ther. Jan. 2017;28(1):125-134.

Powell SK, et al. Viral expression cassette elements to enhance transgene target specificity and expression in gene therapy. Discov Med Jan. 2015;19(102):49-57.

Rosario AM et al. Microglia-specific Targeting by Novel Capsid-modified AAV6 Vectors. Mol Ther Methods Clin Dev. Apr. 13, 2016;3:16026.

Wang L, et al. Productive life cycle of adeno-associated virus serotype 2 in the complete absence of a conventional polyadenylation signal. J Gen Virol. Sep. 2015;96(9):2780-7.

Yan ZY, et al. Optimization of recombinant adeno-associated virus mediated expression for large transgenes, using a synthetic promoter and tandem array enhancers. Hum Gene Ther. Jun. 2015;26(6):334-46.

Jackson KL, et al. Better Targeting, Better Efficiency for Wide-Scale Neuronal Transduction with the Synapsin Promoter and AAV-PHP. B. Front Mol Neurosci. Nov. 2016;6:116.

McClements ME, et al. A fragmented adeno-associated viral dual vector strategy for treatment of diseases caused by mutations in large genes leads to expression of hybrid transcripts. J Genet Syndr Gene Ther. Nov. 2016;7(5):311.

Parr MJ, et al. Tumor-selective transgene expression in vivo mediated by an E2F-responsive adenoviral vector. Nat Med. Oct. 1997;3(10):1145-9.

Reid CA, et al. miRNA mediated post-transcriptional silencing of transgenes leads to increased adeno-associated viral vector yield and targeting specificity. Gene Ther. Jun. 15, 2017. Epub ahead of print.

Sawada Y et al. Inflammation-induced Reversible Switch of the Neuron-specific Enolase Promoter from Purkinje Neurons to Bergmann Glia. Sci Rep Jun. 13, 2016;6:27758.

Lukashcuk V et al. AAV9-mediated central nervous system-targeted gene delivery via cisterna magna route in mice. Mol Ther Methods Clin Dev. Feb. 17, 2016;3:15055.

Tarantal AF, et al. Systemic and Persistent Muscle Gene Expression in Rhesus Monkeys with a Liver De-targeted Adeno-Associated Virus (AAV) Vector. Hum Gene Ther. May 2017;28(5):385-391.

(56) References Cited

OTHER PUBLICATIONS

Huang LY, et al. Characterization of the Adeno-Associated Virus 1 and 6 Sialic Acid Binding Site. J Virol. May 12, 2016;90(11):5219-30.
Siu JJ, et al. Improved gene delivery to adult mouse spinal cord through the use of engineered hybrid adeno-associated viral serotypes. Gene Ther. Apr. 25, 2017. Epub ahead of print.
Deng XF, et al. Replication of an autonomous human parvovirus in non-dividing human airway epithelium is facilitated through the DNA damage and repair pathways. PLoS Pathog. Jan. 2016;12(1):e1005399.
Kailasan S, et al. Structure of an Enteric Pathogen, Bovine Parvovirus.J Virol. Mar. 2015, 89(5):2603-14.
Alton EW, et al. Repeated nebulisation of non-viral CFIR gene therapy in patients with cystic fibrosis: a randomised, double-blind, placebo-controlled, phase 2b trial. Lancet Respir Med Sep. 2015;3(9):684-91.
Baum BJ, et al. Early responses to adenoviral-mediated transfer of the aquaporin-1 cDNA for radiation-induced salivary hypofunction. Proc Natl Acad Sci U S A. Nov. 20, 2012;109(47):19403-7.
Shen W, et al. Analysis of the Cis and Trans Requirements for DNA Replication at the Right End Hairpin of the Human Bocavirus 1 Genome. J Virol. Aug. 2016;90(17):7761-77.
Ferrand M, et al.Serotype-specific Binding Properties and Nanoparticle Characteristics Contribute to the Immunogenicity of rAAV1 Vectors. Mol Ther.Jun. 2015, 23(6):1022-33.
Loring HS, et al. Development of rAAV2-CFTR: History of the First rAAV Vector Product to be Used in Humans. Hum Gene Ther Methods. Apr. 2016;27(2):49-58.
Valdmanis P, et al. Future of rAAV gene therapy: Platform for RNAi, Gene Editing and Beyond. Hum Gene Ther. Apr. 2017;28(4):361-372.
Hocquemiller M et al. Adeno-Associated Virus-Based Gene Therapy for CNS Diseases. Hum Gene Ther. Jul. 2016;27(7):478-96.
Vodicka P, et al. Autophagy Activation by Transcription Factor EB (TFEB) in Striatum of HDQ175/Q7 Mice. J Huntingtons Dis. Oct. 2016;5(3):249-260.
Vodicka P, et al. Effects of Exogenous NUB1 Expression in the Striatum of HDQ175/Q7 Mice. J Huntingtons Dis. Jun. 2016;5(2):163-74.
Amaro IA et al. An Intrabody Drug (rAAV6-INT41) Reduces the Binding of N-Terminal Huntingtin Fragment(s) to DNA to Basal Levels in PC12 Cells and Delays Cognitive Loss in the R6/2 Animal Model. J Neurodegener Dis. 2016;2016:7120753.
Monteys AM, et al. CRISPR/Cas9 Editing of the Mutant Huntingtin Allele In Vitro and In Vivo. Mol Ther. Jan. 2017;25(1):12-23.
Hadaczek P et al. Widespread AAV1- and AAV2-mediated Transgene Expression in the Nonhuman Primate Brain: Implications for Huntington's Disease. Mol Ther Methods Clin Dev. Jun. 29, 2016;3:16037.
Miniarikova J et al. Design, Characterization, and Lead Selection of Therapeutic miRNAs Targeting Huntingtin for Development of Gene Therapy for Huntington's Disease.Mol Ther Nucleic Acids. Mar. 22, 2016;5:e297.
Keeler AM et al. Cellular Analysis of Silencing the Huntington's Disease Gene Using AAV9 Mediated Delivery of Artificial Micro RNA into the Striatum of Q140/Q140 Mice. J Huntingtons Dis. Oct. 1, 2016;5(3):239-248.
Green F, et al. Axonal transport of AAV9 in nonhuman primate brain. Gene Ther. Jun. 2016;23(6):520-6.
Bisset DR, et al. Therapeutic impact of systemic AAV-mediated RNA interference in a mouse model of myotonic dystrophy. Hum Mol Genet. Sep. 2015;24(17):4971-83.
He X, et al. Recombinant adeno-associated virus-mediated inhibition of microRNA-21 protects mice against the lethal schistosome infection by repressing both IL-13 and transforming growth factor beta 1 pathways. Hepatology. Jun. 2015, 61(6):2008-17. d.
Xie J et al. Adeno-Associated Virus-Mediated MicroRNA Delivery and Therapeutics. Semin Liver Dis. Feb. 2015, 35(1):81-8.

Keiser MS et al. Broad distribution of ataxin 1 silencing in rhesus cerebella for spinocerebellar ataxia type 1 therapy. Brain. Dec. 2015;138(Pt 12):3555-66.
Enomoto M, et al. Efficient Gene Suppression in Dorsal Root Ganglia and Spinal Cord Using Adeno-Associated Virus Vectors Encoding Short-Hairpin RNA. Methods Mol Biol. 2016;1364:77-90.
Tse LV, et al. Structure-guided evolution of antigenically distinct adeno-associated virus variants for immune evasion. Proc Natl Acad Sci U S A. May 30, 2017. Epub ahead of print.
Vandamme C, et al. Unraveling the complex story of immune responses to AAV vectors trial after trial. Hum Gene Ther. Aug. 23, 2017.
Mingozzi F, et al. Overcoming the Host Immune Response to Adeno-Associated Virus Gene Delivery Vectors: The Race Between Clearance, Tolerance, Neutralization, and Escape. Annu Rev Virol Sep. 29, 2017;4(1):511-534.
Kim Y, et al. Mutagenic Analysis of an Adeno-Associated Virus Variant Capable of Simultaneously Promoting Immune Resistance and Robust Gene Delivery. Hum Gene Ther. Jun. 24, 2017. Epub ahead of print.
Pillay S, et al. AAV serotypes have distinctive interactions with domains of the cellular receptor AAVR. J Virol. Jul. 5, 2017. Epub ahead of print.
Wang M, Sun J, Crosby A, Woodard K, Hirsch ML, Samulski RJ, Li C. Direct interaction of human serum proteins with AAV virions to enhance AAV transduction: immediate impact on clinical applications. Gene Ther. Jan. 2017;24(1):49-59. doi: 10.1038/gt.2016.75. Epub Nov. 11, 2016.
Bennett A, et al. Thermal Stability as a Determinant of AAV Serotype Identity. Mol Ther Methods Clin Dev. Jul. 24, 2017;6:171-182. doi: 10.1016/j.omtm.2017.07.003.
Bennett A, et al. Understanding capsid assembly and genome packaging for adeno-associated viruses. Future Virology Jun. 2017; 12(6): 283-297.
Grimm et al. Small but increasingly mightly—latest advances in AAV vector research, design and evolution. Hum Gene Ther. Nov. 2017 (Epub Aug. 23, 2017); 28(11):1075-1086.
Pillay S, et al. Host determinants of adeno-associated viral vector entry. Curr Opin Virol. Jun. 30, 2017;24:124-131. Epub ahead of print.
Merkel SF, et al. Trafficking of adeno-associated virus vectors across a model of the blood-brain barrier; a comparative study of transcytosis and transduction using primary human brain endothelial cells. J Neurochem. Jan. 2017;140(2):216-230. doi: 10.1111/jnc. 13861.
Hinderer C, et al. Delivery of an Adeno-Associated Virus Vector into Cerebrospinal Fluid Attenuates Central Nervous System Disease in Mucopolysaccharidosis Type II Mice. Hum Gene Ther. Nov. 2016;27(11):906-915. Epub Aug. 10, 2016.
Gombash SE, et al. Systemic gene delivery transduces the enteric nervous system of guinea pigs and cynomolgus macaques. Gene Ther. Aug. 3, 2017. doi: 10.1038/gt.2017.72.
Hinderer C, et al. Evaluation of intrathecal routes of administration for adeno-associated virus vectors in large animals. Hum Gene Ther. Aug. 15, 2017. doi: 10.1089/hum.2017.026.
Gaura V, et al. Association between motor symptoms and brain metabolism in early huntington disease. JAMA Neurol. Sep. 1, 2017;74(9):1088-1096.
Dietrich P, et al. Elimination of huntingtin in the adult mouse leads to progressive behavioral deficits, bilateral thalamic calcification, and altered brain iron homeostasis. PLoS Genet. Jul. 17, 2017;13(7):e1006846.
Miniarikova J, et al. AAV5-miHTT gene therapy demonstrates suppression of mutant huntingtin aggregation and neuronal dysfunction in a rat model of Huntington's disease. Gene Ther. Aug. 3, 2017. doi: 10.1038/gt.2017.71.
Yang S, et al. CRISPR/Cas9-mediated gene editing ameliorates neurotoxicity in mouse model of Huntington's disease. J Clin Invest. Jun. 19, 2017. Epub ahead of print.

(56) References Cited

OTHER PUBLICATIONS

Pfister EL, et al. Safe and Efficient Silencing with a Pol II, but Not a Pol III, Promoter Expressing an Artificial miRNA Targeting Human Huntingtin. Mol Ther Nucleic Acids. Jun. 16, 2017;7:324-334.
Iwamoto N, et al. Control of phosphorothioate stereochemistry substantially increases the efficacy of antisense oligonucleotides. Nat Biotechnol Aug. 21, 2017.
Kanaan NM, et al. Rationally Engineered AAV Capsids Improve Transduction and Volumetric Spread in the CNS. Molecular Therapy—Nucleic Acids 8:184-197 Sep. 15, 2017.
Chan KY, et al. Engineered AAVs for efficient noninvasive gene delivery to the central and peripheral nervous systems. Nat Neurosci. Jun. 26, 2017. Epub ahead of print.
Herrera-Carrillo E, et al. Improving miRNA delivery by optimizing miRNA expression cassettes in viral vectors. Hum Gene Ther Methods. Jul. 16, 2017.
Evers MM, et al. AAV5-miHTT Gene Therapy Demonstrates Broad Distribution and Strong Human Mutant Huntingtin Lowering in a Huntington's Disease Minipig Model. Mol Ther. Jun. 25, 2018 Epub ahead of print.
Fukuoka M, et al. Supplemental Treatment for Huntington's Disease with miR-132 that Is Deficient in Huntington's Disease Brain. Mol. Ther. Nucleic Acids. Jun. 1, 2018;11:79-90.
Pfister EL, et al. Artificial miRNAs Reduce Human Mutant Huntingtin Throughout the Striatum in a Transgenic Sheep Model of Huntington's Disease. Hum Gene Ther. Jun. 2018;29(6):663-673.
Hudry E, et al. Efficient gene transfer to the central nervous system by single stranded Anc80L65. Mol Ther Meth Clin Dev. Jul. 15, 2018, pp. 197-209.
Koyuncu S, et al. The ubiquitin ligase UBR5 suppresses proteostasis collapse in pluripotent stem cells from Huntington's disease patients. Nat Commun Jul. 23, 2018;9(1):2886.
Marco S, et al. RNAi-Based GluN3A Silencing Prevents and Reverses Disease Phenotypes Induced by Mutant huntingtin. Mol Ther Aug. 1, 2018;26(8):1965-1972.
Chandran JS, et al. Gene therapy in the nervous system: failures and successes. Adv Exp Med Biol. 2017;1007:241-257.
Tse LV, et al. Mapping and engineering function domains of the assembly-activating protein of adeno-associated viruses. J. Virol. Jun. 29, 2018;92(14).
Auyeung VC, et al. Beyond secondary structure: primary sequence determinants license pri-miRNA hairpins for processing. Cell. Feb. 2013;152(4):844-858.
Fellman C, et al. An optimized microRNA backbone for effective single-copy RNAi. Cell Rep. Dec. 2013;5(6):1704-1713.
Gowanlock D, et al. A designer AAV variant permits efficient retrograde access to projection neurons. Neuron. Oct. 19, 2016;92(2):372-382.
Ha et al., Regulation of microRNA biogenesis. Nat Rev Mol Cell Bio, Aug. 2014, vol. 15, No. 8, pp. 509-524.
Boudreau RL, et al. Artificial microRNAs as siRNA shuttles: improved safety as compared to shRNAs in vitro and in vivo. The American Society of Gene Therapy. 2009; 17(1):169-175.
Kawaoka et al. Bombyx small RNAs: genomic defense system against transposons in the silkworm, *Bombyx mori*. Insect Biochem Mol Biol. Dec. 2008;38(12):1058-65. Epub Mar. 27, 2008.
Mestre TA .Recent advances in the therapeutic development for Huntington disease.Parkinsonism Relat Disord. Dec. 12, 2018. [Epub ahead of print].
Wang D, et al. Adeno-associated virus vector as a platform for gene therapy delivery. Nat Rev Drug Discov. Feb. 1, 2019. doi: 10.1038/s41573-019-0012-9. [Epub ahead of print] Review.
Martier R, et al. Artificial microRNAs targeting C9ORF72 have the potential to reduce accumulation of the intra-nuclear transcripts in ALS and FTD patients. Molecular Therapy Nucleic Acids. Jan. 22, 2019. DOI: https://doi.org/10.1016 [Epub ahead of print] Review.
Miniarikova et al., Translation of MicroRNA-Based Huntingtin-Lowering Therapies from Preclinical Studies to the Clinic. Mol Ther. Apr. 4, 2018;26(4):947-962.
Büning and Srivastava. Capsid Modifications for Targeting and Improving the Efficacy of AAV Vectors. vol. 12, p. 248-265, Mar. 15, 2019.
Hudry E, Vandenberghe LH. Therapeutic AAV Gene Transfer to the Nervous System: A Clinical Reality. Neuron. Mar. 6, 2019;101(5):839-862.
Betancur JG et al., miRNA-like duplexes as RNAi triggers with improved specificity. Front Genet. Jul. 12, 2012;3:127.
Chung et al., Polycystronic RNA polymerase II expression vectors for RNA interference based on BIC/miR-155. Nucleic Acids Res. Apr. 13, 2006;34(7):e53.
Cullen BR. Induction of stable RNA interference in mammalian cells. Gene Ther. Mar. 2006;13(6):503-8.
Dow LE et al., A pipeline for the generation of shRNA transgenic mice. Nat Protoc. Feb. 2, 2012;7(2):374-93.
Fellmann C. et al., Functional identification of optimized RNAi triggers using a massivelyparallel sensor assay. Mol Cell. Mar. 18, 2011;41(6):733-46.
Gu S et al., The loop position of shRNAs and pre-miRNAs is critical for the accuracy of dicer processing in vivo. Cell. Nov. 9, 2012;151(4):900-911.
Han J. et al., Molecular basis for the recognition of primary microRNAs by the Drosha-DGCR8 complex. Cell. Jun. 2, 2006;125(5):887-901.
Ketley A. et al., The miR-20 microRNA family targets smoothened to regulate hedgehog signallling in zebrafish early muscle development. PLoS One. Jun. 5, 2013;8(6):e65170.
Liu YP et al., Inhibition of HIV-1 by multiple siRNAs expressed from a single microRNApolycistron. Nucleic Acids Res. May 2008;36(9):2811-24.
Park JE et al., Dicer recognizes the 5' end of RNA for efficient and accurate processing. Nature. Jul. 13, 2011;475(7355):201-5.
Schwarz DS et al., Asymmetry in the assembly of the RNAi enzyme complex. Cell. Oct. 17, 2003;115(2):199-208.
Seitz H et al., A 5'-uridine amplifies miRNA/miRNA* asymmetry in *Drosophila* by promoting RNA-induced silencing complex formation. Silence. Jun. 7, 2011;2:4.
Long et al., Validation of a prognostic index for Huntington's disease. Mov Disord. Feb. 2017;32(2):256-263. Epub Nov. 28, 2016.
Ross et al., Huntington's disease: from molecular pathogenesis to clinical treatment. Lancet Neurol. Jan. 2011;10(1):83-98.
Stanek et al., Silencing mutant huntingtin by adeno-associated virus-mediated RNA interference ameliorates disease manifestations in the YAC128 mouse model of Huntington's disease. Hum Gene Ther. May 2014;25(5):461-74. Epub Mar. 21, 2014.
Walker, Huntington's disease. Lancet. Jan. 20, 2007;369(9557):218-28.
Borel F et al., Recombinant AAV as a platform for translating the therapeutic potential of RNA interference .Mol Ther. Apr. 2014;22(4):692-701.
Carter BJ. Adeno-associated virus and the development of adeno-associated virus vectors: a historical perspective. Mol Ther. Dec. 2004;10(6):981-9.
G. S. Banker, Modern Pharmaceutics, Drugs and the Pharmaceutical Sciences, v. 72, Marcel Dekker, New York, Inc., 1996.
Grimm D, et al. Progress in adeno-associated virus type 2 vector production: promises and prospects for clinical use. Hum Gene Ther. Oct. 10, 1999;10(15):2445-50.
Grimson A, et al. MicroRNA targeting specificity in mammals: determinants beyond seed pairing. Mol Cell. Jul. 6, 2007;27(1):91-105.
Hastie E, et al. Adeno-Associated Virus at 50: A Golden Anniversary of Discovery, Research, and Gene Therapy Success—A Personal Perspective. Hum Gene Ther. May 2015, 26(5):257-65.
Aydemir F, et al. Mutants at the 2-fold interface of AAV2 structural proteins suggest a role in viral transcription for AAV capsids. J Virol. Jul. 2016;90(16):7196-204.
Bantel-Schaal U, et al. Human adeno-associated virus type 5 is only distantly related to other known primate helper-dependent parvoviruses. J Virol. Feb. 1999;73(2):939-47.
Berry Ge, et al. Cellular transduction mechanisms of adeno-associated viral vectors. Curr Opin Virol. Dec. 2016;21:54-60.

(56) References Cited

OTHER PUBLICATIONS

Chiorini JA, et al. Adeno-associated virus (AAV) type 5 Rep protein cleaves a unique terminal resolution site compared with other AAV serotypes. J Virol. May 1999;73(5):4293-8.

Chiorini JA, et al. Cloning and characterization of adeno-associated virus type 5. J Virol. Feb. 1999;73(2):1309-19.

Chiorini JA, et al. Cloning of adeno-associated virus type 4 (AAV4) and generation of recombinant AAV4 particles. J Virol. Sep. 1997;71(9):6823-33.

Earley LF, et al. Adeno-Associated Virus Assembly-Activating Protein Is Not an Essential Requirement for Capsid Assembly of AAV Serotypes 4, 5 and 11. J Virol. Jan. 2017;91(3):pii:e0198-16.

Ding C, et al., Biochemical Characterization of Junonia Coenia Densovirus Nonstructural Protein NS-1. J. Virol., 76(1):338-345 2002.

Adachi K, et al. Drawing a high-resolution functional map of adeno-associated virus capsid by massively parallel sequencing. Nat Commun. 2014;5:3075. doi: 10.1038/ncomms4075.

Altschul SF, et al. Basic local alignment search tool. J Mol Biol. Oct. 5, 1990;215(3):403-10.

Carillo H, et al. The Multiple Sequence Alignment Problem in Biology. SIAM J. Appl. Math. 48-5 (1988), pp. 1073-1082.

Devereux J A comprehensive set of sequence analysis programs for the VAX. Nucleic Acids Res. Jan. 11, 1984;12(1 Pt 1):387-95.

Gribskov M, et al. Sequence Analysis Primer. M Stockton Press, New York, 1991.

Griffin AM, et al. Computer Analysis of Sequence Data, Part I. Humana Press, New Jersey, 1994.

Berge SM Pharmaceutical salts. J Pharm Sci. Jan. 1977;66(1):1-19.

Bell P, et al. Effects of self-complementarity, codon optimization, transgene, and dose on liver transduction with AAV8. Hum Gene Ther Methods. Dec. 2016;27(6):228-237.

Heim et al., Wavelength mutations and posttranslational autoxidation of green fluorescent protein. Proc. Natl. Acad. Sci. USA (1994).

Hastie E, et al. Recombinant adeno-associated virus vectors in the treatment of rare diseases. Expert Opin Orphan Drugs. 2015;3(6):675-689.

Fargnoli AS, et al. Liquid jet delivery method featuring S100A1 gene therapy in the rodent model following acute myocardial infarction. Gene Ther. Feb. 2016;23(2):151-7.

Aubourg P. Gene therapy for rare central nervous system diseases comes to age. Endocr Dev. 2016;30:141-6.

Bankiewicz KS et al. AAV Viral Vector Delivery to the Brain by Shape-conforming MR-guided Infusions. J Control Release. Oct. 28, 2016;240:434-442.

Bey K, et al. Efficient CNS targeting in adult mice by intrathecal infusion of single-stranded AAV9-GFP for gene therapy of neurological disorders. Gene Ther. Apr. 20, 2017. Epub ahead of print.

Brulet R, et al. NEUROD1 Instructs Neuronal Conversion in Non-Reactive Astrocytes. Stem Cell Reports. May 11, 2017. Epub ahead of print.

Cabral-Miranda F, et al. rAAV8-733-Mediated Gene Transfer of CHIP/Stub-1 Prevents Hippocampal Neuronal Death in Experimental Brain Ischemia. Mol Ther. Feb. 2017;25(2):392-400.

Chandler RJ, et al. Systemic AAV9 gene therapy improves the lifespan of mice with Niemann-Pick disease, type C1. Hum Mol Genet. Jan. 2017;26(1):52-64.

Dang CH, et al. In vivo dynamics of AAV-mediated gene delivery to sensory neurons of the trigeminal ganglia. Sci Rep. Apr. 19, 2017;7(1):927.

Dimidschstein J, et al. A viral strategy for targeting and manipulating interneurons across vertebrate species. Nat Neurosci. Dec. 2016;19(12):1743-1749.

Donsante A et al. Intracerebroventricular delivery of self-complementary adeno-associated virus serotype 9 to the adult rat brain. Gene Ther. May 2016;23(5):401-7.

El-Shamayleh Y, et al. Strategies for targeting primate neural circuits with viral vectors. J Neurophysiol. Jul. 2016;116(1):122-34.

Foust KD, et al. Intravascular AAV9 preferentially targets neonatal neurons and adult astrocytes. Nat Biotechnol. Jan. 2009;27(1):59-65. doi: 10.1038/nbt.1515. Epub Dec. 21, 2008.

Gessler DJ et al. Gene Therapy for the Treatment of Neurological Disorders: Metabolic Disorders. Methods Mol Biol. 2016;1382:429-65.

Gilkes JA et al. Preferred Transduction with AAV8 and AAV9 Via Thalamic Administration in the MPS IIIB Model: A Comparison of Four rAAV Serotypes. Mol Genet Metab Rep. Dec. 7, 2015;6:48-54.

Gombash SE, et al. Systemic Gene Therapy for Targeting the CNS. Methods Mol Biol. 2016;1382:231-7.

Gurda BL, et al. Evaluation of AAV-mediated gene therapy for central nervous system disease in canine mucopolysaccharidosis VII. Mol Ther. Feb. 2016;24(2):206-16.

Ahmed SS, et al. rAAV gene therapy in a Canavan's disease mouse model reveals immune impairments and an extended pathology beyond the central nervous system. Mol Ther. Jun. 2016;24(6):1030-41.

Dashkoff J, et al. Tailored transgene expression to specific cell types in the central nervous system after peripheral injection with AAV9. Mol Ther Methods Clin Dev. Dec. 2016;3:16081.

Gruntman AM, et al. Retro-Orbital Venous Sinus Delivery of rAAV9 Mediates High-Level Transduction of Brain and Retina Compared with Temporal Vein Delivery in Neonatal Mouse Pups. Hum Gene Ther. Mar. 2017;28(3):228-230.

Aoyama Y, et al. Wnt11 gene therapy with adeno-associated virus 9 improves the survival of mice with myocarditis induced by coxsackievirus B3 through the suppression of the inflammatory reaction. J Mol Cell Cardiol. Jul. 2015;84:45-51.

Greig JA, et al. Impact of intravenous infusion time on AAV8 vector pharmacokinetics, safety, and liver transduction in cynomolgus macaques. Mol Ther Methods Clin Dev. Dec. 2016;3:16079.

Gruntman AM, et al. Delivery of Adeno-associated virus gene therapy by intravascular limb infusion methods. Hum Gene Ther Clin Dev Sep. 2015;26(3):159-64.

Hagg A, et al. Using AAV vectors expressing the beta 2-adrenoceptor or associated G alpha proteins to modulate skeletal muscle mass and muscle fiber size. Sci Rep. Mar. 2016;6:23042.

Greig JA, et al. Intramuscular administration of AAV overcomes pre-existing neutralizing antibodies in rhesus macaques. Vaccine. Dec. 2016;34(50):6323-6329.

Al J, et al. Adeno-associated virus serotype rh.10 displays strong muscle tropism following intraperitoneal delivery. Sci Rep. Jan. 2017;7:40336.

Baum BJ, et al. Advances in salivary gland gene therapy—oral and systemic implications. Expert Opinion on Biological Therapy. 2015;15(10):1443-54.

Hai B, et al. Long-term transduction of miniature pig parotid glands using serotype 2 adeno-associated viral vectors. J Gene Med. Jun. 2009;11(6):506-14.

Pfeifer A et al., Pharmacological potential of RNAi-focus on miRNA. Pharmacol Ther. Jun. 2010;126(3):217-27.

Xie J et al., Short DNA Hairpins Compromise Recombinant Adeno-Associated Virus Genome Homogeneity. Mol Ther. Jun. 7, 2017;25(6):1363-1374.

Tereshchenko A et al., Brain structure in juvenile-onset Huntington disease. Neurology. Apr. 10, 2019.

Miniarikova J et al., Translation of MicroRNA-Based Huntingtin-Lowering Therapies from Preclinical Studies to the Clinic.

Spronck et al., AAV5-miHTT Gene Therapy Demonstrates Sustained Huntingtin Lowering and Functional Improvement in Huntington Disease Mouse Models. Mol Ther Methods Clin Dev. Mar. 16, 2019;13:334-343.

Challis et al., Systemic AAV vectors for widespread and targeted gene delivery in rodents. Nat Protoc. Feb. 2019;14(2):379-414.

Elbashir et al., Functional anatomy of siRNAs for mediating efficient RNAi in *Drosophila* melanogaster embryo lysate. EMBO J. Dec. 3, 2001; 20(23):6877-88.

Powell et al., Viral Expression Cassette Elements to Enhance Transgene Target Specificity and Expression in Gene Therapy. Discov Med. Jan. 2015;19(102):49-57.

(56) References Cited

OTHER PUBLICATIONS

Tabrizi SJ et al., Targeting Huntingtin Expression in Patients with Huntington's Disease. N Engl J Med. May 6, 2019. [Epub ahead of print].
Zeitler et al., Allele-selective transcriptional repression of mutant HTT for the treatment of Huntington's disease. Nat Med Jul. 2019;25(7):1131-1142.
Bofill-De Ros et al. Guidelines for the optimal design of miRNA-based shRNAs. Methods. Jul. 1, 2016;103:157-66.
Miyagishi et al. Optimization of an siRNA-expression system with an improved hairpin and its significant suppressive effects in mammalian cells. The Journal of Gene Medicine: A cross-disciplinary journal for research on the science of gene transfer and its clinical applications. Jul. 2004;6(7):715-23.
Du et al. Design of expression vectors for RNA interference based on miRNAs and RNA splicing. The FEBS journal. Dec. 2006;273(23):5421-7.
Calloni et al. Scaffolds for artificial miRNA expression in animal cells. Human gene therapy methods. Aug. 27, 2015;26(5):162-74.
Schopman et al. Optimization of shRNA inhibitors by variation of the terminal loop sequence. Antiviral research. May 1,2010;86(2):204-11.
Keskin et al., AAV5-miHTT Lowers Huntingtin mRNA and Protein without Off-Target Effects in Patient-Derived Neuronal Cultures and Astrocytes. Mol Ther Methods Clin Dev. Oct. 4, 2019;15:275-284.
Kotowska-Zimmer et al., Universal RNAi triggers for the specific inhibition of mutant huntingtin, atrophin-1, ataxin-3 and ataxin-7 expression. Molecular Therapy Nucleic Acids. Dec. 19, 2019.
Chung et al., Polycistronic RNA polymerase II expression vectors for RNA interference based on BIC/miR-155. Nucleic acids research. Jan. 1, 2006;34(7):e53.
Abstracts from HSG 2017, Neurotherapeutics (2018) 15:233-269.
Nicolson SC, et al. Identification and validation of small molecules that enhance recombinant Adeno-associated virus transduction following high throughput screen. J Virol. Jul. 2016;90(16):7019-31.
Wang M, et al. Direct interaction of human serum proteins with AAV virions to enhance AAV transduction: Immediate impact on clinical applications. Gene Ther. Jan. 2017;24(1):49-59.
Watakabe A, et al. Comparative analyses of adeno-associated viral vector serotypes 1 2 5 8 and 9 in marmoset mouse and macaque cerebral cortex. Neurosci Res.Apr. 2015, 93:144-57.
Xiao P, et al. Disruption of microtubules post virus entry enhances adeno-associated virus vector transduction Hum Gene Ther. Apr. 2016;27(4):309-24.
Hudry EM, et al. Exosome-associated AAV vector as a robust and convenient neursocience tool. Gene Ther. Apr. 2016;23(4):380-92.
Nery FC, et al. New methods for investigation of neuronal migration in embryonic brain explants J Neurosci Methods.Jan. 2015, 239:80-4.
Su W et al. Recombinant adeno-associated viral (rAAV) vectors mediate efficient gene transduction in cultured neonatal and adult microglia. J Neurochem. Jan. 2016;136 Suppl 1:49-62.
Ren XF, et al. Adeno-associated virus-mediated BMP-7 and SOX9 in vitro co-transfection of human degenerative intervertebral disc cells. Genet Mol Res. Apr. 22, 2015;14(2):3736-44.
Alves S et al. Ultramicroscopy as a Novel Tool to Unravel the Tropism of AAV Gene Therapy Vectors in the Brain. Sci Rep. Jun. 20, 2016;6:28272.
Kothari P, et al. Radioiodinated Capsids Facilitate In Vivo Non-Invasive Tracking of Adeno-Associated Gene Transfer Vectors. Sci Rep. Jan. 2017;7:39594.
Xie Q, et al. The 2.8 Å Electron Microscopy Structure of Adeno-Associated Virus-DJ Bound by a Heparinoid Pentasaccharide. Mol Ther Methods Clin Dev. Mar. 8, 2017;5:1-12.
Srivastava A. Adeno-Associated Virus: The Naturally Occurring Virus Versus the Recombinant Vector. Hum Gene Ther. Jan. 2016;27(1):1-6.
Thorne B, et al. Gene Therapy. Adv Biochem Eng Biotechnol. Mar. 14, 2017 Epub ahead of print.
Tratschin JD, et al. Adeno-associated virus vector for high-frequency integration, expression, and rescue of genes in mammalian cells. Mol Cell Biol. Nov. 1985;5(11):3251-60.
Srivastava A, et al. Nucleotide sequence and organization of the adeno-associated virus 2 genome. J Virol. Feb. 1983;45(2):555-64.
Summerford C, et al. AAVR: A multi-serotype receptor for AAV. Mol Ther. Apr. 2016;24(4):663-6.
Xie Q, et al. The atomic structure of adeno-associated virus (AAV-2), a vector for human gene therapy. Proc Natl Acad Sci U S A. Aug. 6, 2002;99(16):10405-10. Epub Jul. 22, 2002.
Wu P, et al. Mutational analysis of the adeno-associated virus type 2 (AAV2) capsid gene and construction of AAV2 vectors with altered tropism. J Virol. Sep. 2000;74(18):8635-47.
Von Heinje G. Sequence Analysis in Molecular Biology. Academic Press, 1987.
Stahl PH, et al. Pharmaceutical Salts: Properties, Selection, and Use. Wiley-VCH, 2008.
Yang C, et al. Sequential adeno-associated viral vector serotype 9-green fluorescent protein gene transfer causes massive inflammation and intense immune response in rat striatum. Hum Gene Ther. Jul. 2016;27(7):528-43.
Chandler RJ, et al. rAAV integration and genotoxicity: insights from animal models. Hum Gene Ther. Apr. 2017;28(4):314-322.
Ye L., et al. Adeno-Associated Virus Vector Mediated Delivery of the HBV Genome Induces Chronic Hepatitis B Virus Infection and Liver Fibrosis in Mice. PLoS One. Jun. 2015, 10(6):e0130052.
Wang S, et al. Direct brain infusion can be enhanced with focused ultrasound and microbubbles. J Cereb Blood Flow Metab. Feb. 2017;37(2):706-714.
Wang et al., Noninvasive, neuron-specific gene therapy can be facilitated by focused ultrasound and recombinant adeno-associated virus. Gene Therapy. Nov. 22, 2014, 104-110.
Weber-Adrian D, et al. Gene delivery to the spinal cord using MRI-guided focused ultrasound. Gene Ther. Jul. 2015, 22(7):568-77.
Wu D et al. Expressing Constitutively Active Rheb in Adult Dorsal Root Ganglion Neurons Enhances the Integration of Sensory Axons that Regenerate Across a Chondroitinase-Treated Dorsal Root Entry Zone Following Dorsal Root Crush. Front Mol Neurosci. Jul. 5, 2016;9:49.
Zhu W, et al. Soluble FLT1 Gene Therapy Alleviates Brain Arteriovenous Malformation Severity. Stroke. May 2017;48(5):1420-1423.
Watson ZL, et al. Adeno-associated Virus Vectors Efficiently Transduce Mouse and Rabbit Sensory Neurons Coinfected with Herpes Simplex Virus 1 following Peripheral Inoculation. J Virol. Aug. 12, 2016;90(17):7894-901.
Suzuki J, et al. Cochlear gene therapy with ancestral AAV in adult mice: complete transduction of inner hair cells without cochlear dysfunction. Apr. 3, 2017;7:45524.
Woodard KT et al. Heparan Sulfate Binding Promotes Accumulation of Intravitreally Delivered Adeno-associated Viral Vectors at the Retina for Enhanced Transduction but Weakly Influences Tropism. J Virol. Oct. 14, 2016;90(21):9878-9888.
Wang LL, et al. Comparative study of liver gene transfer with AAV vectors based on endogenous and engineered AAV capsids. Mol Ther. Dec. 2015;23(12):1877-87.
Sondhi D, et al. Genetic Modification of the Lung Directed Toward Treatment of Human Disease. Hum Gene Ther. Jan. 2017;28(1):3-84.
Yalvac ME, et al. AAV1.NT-3 gene therapy attenuates spontaneous autoimmune peripheral polyneuropathy. Gene Ther. Jan. 2016;23(1):95-102.
Srivastava A. In Vivo Tissue-tropism of Adeno-associated Viral Vectors. Curr Opin Virol. Sep. 2, 2016;21:75-80.
Adamson-Small L, et al. Sodium chloride enhances rAAV production in a serum-free suspension manufacturing platform using the Herpes Simplex Virus System. Hum Gene Ther Methods. Feb. 2017;28(1):1-14.
Ai J, et al. A Scalable and Accurate Method for Quantifying Vector Genomes of Recombinant Adeno-Associated Viruses in Crude Lysate. Hum Gene Ther Methods. Apr. 13, 2017. Epub ahead of print.

(56) References Cited

OTHER PUBLICATIONS

Buclez PO, et al. Rapid, scalable, and low-cost purification of recombinant adeno-associated virus produced by baculovirus expression vector system. Mol Ther Methods Clin Dev. May 2016;3:16035.
Burnham B, et al. Analytical ultracentrifugation as an approach to characterize recombinant adeno-associated viral vectors. Hum Gene Ther Methods. Dec. 2015;26(6):228-42.
Clement N, et al. Manufacturing of recombinant adeno-associated viral vectors for clinical trials. Mol Ther Methods Clin Dev. Mar. 2016;3:16002.
D'Costa S, et al. Practical utilization of recombinant AAV vector reference standards: focus on vector genome titration by free ITR qPCR. Mol Ther Methods Clin Dev. Mar. 2016;5:16019.
Grieger JC, et al. Production of Recombinant Adeno-associated Virus Vectors Using Suspension HEK293 Cells and Continuous Harvest of Vector From the Culture Media for GMP FIX and FLT1 Clinical Vector. Mol Ther. Feb. 2016;24(2):287-97.
Gruntman AM, et al. Stability and Compatibility of Recombinant Adeno-Associated Virus Under Conditions Commonly Encountered in Human Gene Therapy Trials. Hum Gene Ther Methods. Apr. 2015, 26(2):71-6.
Kajigaya S, et al. Self-assembled B19 parvovirus capsids, produced in a baculovirus system, are antigenically and immunogenically similar to native virions. Proc Natl Acad Sci U S A. Jun. 1, 1991;88(11):4646-50.
Kirnbauer R, et al. Virus-like particles of bovine papillomavirus type 4 in prophylactic and therapeutic immunization. Virology. May 1, 1996;219(1):37-44.
Kohlbrenner E, et al. Production and Characterization of Vectors Based on the Cardiotropic AAV Serotype 9. Methods Mol Biol. 2017;1521:91-107.
Kotin RM, et al. Large-scale recombinant adeno-associated virus production. Hum Mol Genet. Apr. 15, 2011;20(R1):R2-6. doi: 10.1093/hmg/ddr141. Epub Apr. 29, 2011.
Kotin RM, et al. Manufacturing clinical grade recombinant adeno-associated virus using invertebrate cell lines. Hum Gene Ther. Mar. 28, 2017. Epub ahead of print.
Kotterman MA, et al. Enhanced cellular secretion of AAV2 by expression of foreign viral envelope proteins. Biochemical Engineering Journal, vol. 93, Jan. 15, 2015, pp. 108-114.
Methods in Molecular Biology, ed. Richard, Humana Press, NJ (1995).
Maniatis T. et al.,Molecular Cloning. CSH Laboratory, NY, N.Y. (1982).
Merten OW, et al. Viral vectors for gene therapy and gene modification approaches. Biochem Eng J. Apr. 2016;108:98-115.
Muzyczka N, et al. AAV's Golden Jubilee. Mol Ther. May 2015;23(5):807-8.
Philiport, et al. Liposomes as tools in Basic Research and Industry. CRC Press, Ann Arbor, Mich. (1995).
Kailasan S, et al. Parvovirus Family Conundrum: What makes a killer? Annu Rev Virol. Nov. 2015;2(1):425-50.
Rutledge EA, et al. Infectious clones and vectors derived from adeno-associated virus (AAV) serotypes other than AAV type 2. J Virol. Jan. 1998;72(1):309-19.
Pillay S, et al. An essential receptor for adeno-associated virus infection. Nature. Nov. 17, 2016;539(7629):456.
Platt MP, et al. Embryonic disruption of the candidate dyslexia susceptibility gene homolog Kiaa0319-like results in neuronal migration disorders. Neuroscience. Sep. 17, 2013;248:585-93.
Poon MW, et al. Distribution of Kiaa0319-like immunoreactivity in the adult mouse brain—a novel protein encoded by the putative dyslexia susceptibility gene KIAA0319-like. Histol Histopathol. Aug. 2011;26(8):953-63.
Poon MW, et al. Dyslexia-associated kiaa0319-like protein interacts with axon guidance receptor nogo receptor 1. Cell Mol Neurobiol. Jan. 2011;31(1):27-35.
Myers EW, et al. Optimal alignments in linear space. Comput Appl Biosci. Mar. 1988;4(1):11-7.
Smith DW, et al. Biocomputing: Informatics and Genome Projects. Academic Press, New York, 1993.
Kozak M. Interpreting cDNA sequences: some insights from studies on translation. Mamm Genome. Aug. 1996;7(8):563-74.
Kozak M. Point mutations define a sequence flanking the AUG initiator codon that modulates translation by eukaryotic ribosomes. Cell. Jan. 31, 1986;44(2):283-92.
Kozak M. The scanning model for translation: an update. J Cell Biol. Feb. 1989;108(2):229-41.
Heim R, et al. Engineering green fluorescent protein for improved brightness, longer wavelengths and fluorescence resonance energy transfer. Curr Biol. Feb. 1, 1996;6(2):178-82.
Heim R, et al. Improved green fluorescence Nature 373, 663-664 (Feb. 23, 1995); doi:10.1038/373663b0.
Nygaard S, et al. A universal system to select gene-modified hepatocytes in vivo. Sci Transl Med. Jun. 2016;8(342):342ra79.
Smith RH, et al. Germline viral "fossils" guide in silico reconstruction of a mid-Cenozoic era marsupial adeno-associated virus. Sci Rep. Jul. 2016;6:28965.
Li L, et al. Production and characterization of novel recombinant adeno-associated virus replicative-form genomes: a eukaryotic source of DNA for gene transfer. PLoS One. Aug. 1, 2013;8(8):e69879. doi: 10.1371/journal.pone.0069879. Print 2013.
O'Reilly DR, et al. Baculovirus expression vectors: a laboratory manual. Oxford University Press, 1994.
Oliva B, et al. An automated classification of the structure of protein loops. J Mol Biol. Mar. 7, 1997;266(4):814-30.
Samaranch L, et al. MR-guided parenchymal delivery of adeno-associated viral vector serotype 5 in non-human primate brain. Gene Ther. Apr. 2017;24(4):253-261.
Petit L, et al. Rod Outer Segment Development Influences AAV-Mediated Photoreceptor Transduction After Subretinal Injection. Hum Gene Ther. May 16, 2017. Epub ahead of print.
Hinderer C et al. Delivery of an Adeno-Associated Virus Vector into CSF Attenuates Central Nervous System Disease in Mucopolysaccharidosis Type II Mice Hum Gene Ther. Aug. 10, 2016.
Hordeaux J., et al. Efficient central nervous system AAVrh10-mediated intrathecal gene transfers in adult and neonate rats. Gene Ther.Apr. 2015, 22(4):316-24.
Merkel SF et al. Trafficking of AAV Vectors Across a Model of the Blood-Brain Barrier; a Comaparative Study of Transcytosis and Transduction Using Primary Human Brain Endothelial Cells. J Neurochem. Oct. 8, 2016.
Miyanohara A et al. Potent Spinal Parenchymal AAV9-mediated Gene Delivery by Subpial Injection in Adult Rats and Pigs. Mol Ther Methods Clin Dev. Jul. 13, 2016;3:16046.
Muralidharan G , et al. Unique glycan signatures regulate adeno-associated virus tropism in the developing brain. J Virol. Apr. 2015;89(7):3976-87.
Ponder K, et al. Intrathecal injection of lentiviral vector results in high expression in the brain of mucopolysaccharidosis VII dogs but the pattern of expression is different than for AAV9 or AAV-rh10. J Control Release. Dec. 2014, 196:71-8.
Salegio EA, et al. MRI-Guided Delivery of Viral Vectors. Methods Mol Viol. 2016;1382:217-30.
Samaranch L et al. Cerebellomedullary Cistern Delivery for AAV-Based Gene Therapy: A Technical Note for Nonhuman Primates. Hum Gene Ther Methods. Feb. 2016;27(1):13-6.
Saraiva J et al. Gene Therapy for the CNS Using AAVs: The Impact of Systemic Delivery by AAV9. J Control Release Nov. 10, 2016;241:94-109.
Shen F, et al. Inhibition of pathological brain angiogenesis through systemic delivery of AAV vector expressing soluble FLT1. Gene Therapy. Nov. 22, 2015(11):893-900.
Hinderer C, et al. Neonatal Systemic AAV Induces Tolerance to CNS Gene Therapy in MPS I Dogs and Nonhuman Primates. Mol Ther. Aug. 2015, 23(8):1298-307.
Ojala DS, et al. Adeno-associated virus vectors and neurological gene therapy. Neuroscientist. Feb. 2015;21(1):84-98.
Katz ML, et al. AAV gene transfer delays disease onset in a TPP1-deficient canine model of the late infantile form of Batten Disease. Sci Transl Med. Nov. 2015;7(313):313ra180.

(56) References Cited

OTHER PUBLICATIONS

Kothari P, et al. Iodine-124 Labeled Adeno-Associated Virus: A Promising Tool for Tracking Gene Therapy. Journal of Nuclear Medicine. May 2015, 56 (supplement 3), 494-494.

Landegger LD, et al. A synthetic AAV vector enables safe and efficient gene transfer to the mammalian inner ear. Nat Biotechnol. Mar. 2017;35(3):280-284.

Mason JB, et al. Delivery and evaluation of recombinant adeno-associated viral vectors in the equine distal extremity for the treatment of laminitis. Equine Vet J. Jan. 2017;49(1):79-86.

Jeong D, et al. Matricellular Protein CCN5 Reverses Established Cardiac Fibrosis. J Am Coll Cardiol. Apr. 5, 2016;67(13):1556-68.

Knezevic T, et al. Adeno-associated Virus Serotype 9—Driven Expression of BAG3 Improves Left Ventricular Function in Murine Hearts with Left Ventricular Dysfunction Secondary to a Myocardial Infarction. JACC Basic Transl Sci. Dec. 2016;1(7):647-656.

Brahim S, et al. Stable liver specific expression of human IDOL in humanized mice raises plasma cholesterol. Cardiovasc Res. May 2016;110(1):23-9.

Li Sy, et al. Efficient and targeted transduction of nonhuman primate liver with systemically delivered optimized AAV3B vectors. Mol Ther. Dec. 2015;23(12):1867-76.

Heller KN, et al. Human alpha 7 integrin gene (ITGA7) delivered by adeno-associated virus extends survival of severely affected dystrophin/utrophin deficient mice. Oct. 2015;26(10):647-56.

Mendell JR, et al. Follistatin Gene Therapy for Sporadic Inclusion Body Myositis Improves Functional Outcomes. Mol Ther. Apr. 2017;25(4):870-879.

Schnepp BC, et al. Recombinant adeno-associated virus vector genomes take the form of long-lived transcriptionally competent episomes in human muscle. Hum Gene Ther Jan. 2016;27(1):32-42.

Murlidharan G et al. Glymphatic Fluid Transport Controls Paravascular Clearance of AAV Vectors from the Brain. JCI Insight. Sep. 8, 2016;1(14).

Neuberger Ewi, et al. Establishment of two quantitative nested qPCR assays targeting the human EPO transgene. Gene Ther Apr. 2016;23(4):330-9.

Lentz TB, et al. Insight into the Mechanism of Inhibition of Adeno-Associated Virus by the Mre11/Rad50/Nbs1 Complex. J Virol. Jan. 2015, 89(1):181-94.

Extended European Search Report issued in European Application No. 18794572.0, dated Jan. 11, 2021, 11 pages.

Mietzsch M, et al. OneBac 2.0: Sf9 Cell Lines for Production of AAV1, AAV2 and AAV8 Vectors with Minimal Encapsidation of Foreign DNA. Hum Gene Ther Methods. Feb. 2017;28(1):15-22.

Mietzsch M, et al. OneBac 2.0: Sf9 cell lines for production of AAV5 vectors with enhanced infectivity and minimal encapsidation of foreign DNA. Hum Gene Ther. Oct. 201526(10):688-97.

Nambiar B, et al. Characteristics of minimally oversized adeno-associated virus vectors encoding human Factor VIII generated using producer cell lines and triple transfection. Hum Gene Ther Methods. Feb. 2017;28(1):23-38.

Pacouret S, et al. AAV-ID: A Rapid and Robust Assay for Batch-to-Batch Consistency Evaluation of AAV Preparations. Mol Ther. Apr. 17, 2017. Epub ahead of print.

Penaud-Budloo M, et al. Accurate identification and quantification of DNA species by next-generation sequencing in adeno-associated viral vectors produced in insect cells. Hum Gene Ther Methods. May 2, 2017. Epub ahead of print.

Ruffing M, et al. Assembly of viruslike particles by recombinant structural proteins of adeno-associated virus type 2 in insect cells. J Virol. Dec. 1992,66(12):6922-30.

Samulski RJ, et al. Helper-free stocks of recombinant adeno-associated viruses: normal integration does not require viral gene expression. J Virol. Sep. 1989;63(9):3822-8.

Smith RH, et al. A simplified baculovirus-AAV expression vector system coupled with one-step affinity purification yields high-titer rAAV stocks from insect cells. Mol Ther. Nov. 2009;17(11):1888-96. doi: 10.1038/mt.2009.128. Epub Jun. 16, 2009.

Urabe M, et al. Scalable generation of high-titer recombinant adeno-associated virus type 5 in insect cells. J Virol. Feb. 2006;80(4):1874-85.

Van Der Loo JCM, et al. Progress and challenges in viral vector manufacturing. Hum Mol Genet. Apr. 2016;25(R1):R42-52.

Wasilko DJ, et al. The titerless infected-cells preservation and scale-up (TIPS) method for large-scale production of NO-sensitive human soluble guanylate cyclase (sGC) from insect cells infected with recombinant baculovirus. Protein Expr Purif. Jun. 2009;65(2):122-32. doi: 10.1016/j.pep.2009.01.002. Epub Jan. 11, 2009.

Zhao KN, et al. BPV1 E2 protein enhances packaging of full-length plasmid DNA in BPV1 pseudovirions. Virology. Jul. 5, 2000;272(2):382-93.

Pierson EE, et al. Resolving adeno-associated viral particle diversity with charge detection mass spectrometry. Anal Chem. Jul. 2016;88(13):6718-25.

Rashnonejad A, et al. Large-Scale Production of Adeno-Associated Viral Vector Serotype-9 Carrying the Human Survival Motor Neuron Gene. Mol Biotechnol. Jan. 2016;58(1):30-6.

Ling C, et al. Strategies to generate high-titer, high-potency recombinant AAV3 serotype vectors. Mol Ther Methods Clin Dev. May 2016;3:16029.

Afione S, et al. Identification and Mutagenesis of the Adeno-Associated Virus 5 Sialic Acid Binding Region.J Virol. Feb. 2015, 89(3):1660-72.

Drouin LM, et al. Cryo-electron microscopy reconstruction and stability studies of Wild-Type and R432A Variant of AAV2 Reveals Capsid Structural Stability is a Major Factor in Genome Packaging. J Virol. Sep. 2016;90(19):8542-51.

Halder S, et al. Structure of neurotropic adeno-associated virus AAVrh.8. J Struct Biol. Oct. 2015;192(1):21-36.

Huang LY, et al. Characterization of the adeno-associated virus 1 and 6 sialic acid binding site. J Virol. May 2016;90(11):5219-30.

Mao Y, et al. Single point mutation in adeno-associated viral vectors—DJ capsid leads to improvement for gene delivery in vivo. BMC Biotechnol. Jan. 2016;16:1.

Marsic D et al. Altering Tropism of rAAV by Directed Evolution. Methods of Mol Biol. 2016;1382:151-73.

Tu MY, et al. Role of capsid proteins in parvoviruses infection. Virol J. Aug. 2015, 4;12:114.

Zeng C, et al. Probing the Link between Genomic Cargo, Contact Mechanics and Nanoindentation in Recombinant Adeno-Associated Virus 2. J Phys Chem B. Mar. 2017;121(8):1843-1853.

Zinn E, et al. In Silico Reconstruction of the Viral Evolutionary Lineage Yields a Potent Gene Therapy Vector. Cell Rep. Aug. 2015, 12(6):1056-68.

Grimm D, et al. E Pluribus Unum: 50 years of research, millions of viruses and one goal—tailored acceleration of AAV evolution. Mol Ther. Dec. 2015;23(12):1819-1831.

Karamuthil-Melethil S, et al. Novel Vector Design and Hexosaminidase Variant Enabling Self-Complementary Adeno-Associated Virus for the Treatment of Tay-Sachs Disease. Hum Gene Ther. Jul. 2016;27(7):509-21.

Ling C, et al. Development of Optimized AAV Serotype Vectors for High-Efficiency Transduction at Further Reduced Doses. Hum Gene Ther Methods. Aug. 2016;27(4):143-9.

Pillay S, et al. An essential receptor for adeno-associated virus infection. Nature. Feb. 2016;530(7588):108-12.

Li BZ, et al. Site directed mutagenesis of surface-exposed lysine residues leads to improved transduction by AAV2 but not AAV8 vectors in murine hepatocytes in vivo. Hum Gene Ther Methods. Dec. 2015;26(6):211-20.

Shen S, et al. Functional Analysis of the Putative Integrin Recognition Motif on Adeno-associated virus 9. J Biol Chem. Jan. 2015, 290(3):1496-504.

Steines B, et al. CFTR gene transfer with AAV improves early cystic fibrosis pig phenotypes. JCI Insight. Sep. 2016;1(14):e88728.

Bensky MJ, et al. Targeted gene delivery to the enteric nervous system using AAV: a comparison across serotypes and capsid mutants.Mol Ther. Mar. 2015;23(3):488-500.

Castle MJ, et al. Controlling AAV Tropism in the Nervous System with Natural and Engineered Capsids. Methods Mol Biol. 2016;1382:133-49.

(56) References Cited

OTHER PUBLICATIONS

Choudhury SR, et al. Widespread CNS gene transfer and silencing after systemic delivery of novel AAV-AS vectors. Mol Ther. Apr. 2016;24(4):726-35.
Davis AS, et al. Rational design and engineering of a modified adeno-associated virus (AAV1)-based vector system tor enhanced retrograde gene delivery. Neurosurgery. Feb. 2015;76(2):216-25.
Deverman BE et al. Cre-dependent selection yields AAV variants for widespread gene transfer to the adult brain. Nat Biotechnol. Feb. 2016;34(2):204-9.
Powell SK et al. Characterization of a novel adeno-associated viral vector with preferential oligodendrocyte tropism. Gene Ther. Sep. 15, 2016.
Tervo et al. A Designer AAV Variant Permits Efficient Retrograde Access to Projection Neurons. Neuron. Oct. 19, 2016;92(2):372-382.
Choudhury et al. In Vivo Selection Yields AAV-B1 Capsid for Central Nervous System and Muscle Gene Therapy. Mol Ther. Aug. 2016;24(7):1247-57.
Keravala A, et al. Evaluating AAV Hybrid Variants for Improved Tropism after Intravitreal Gene Delivery to the Retina. Molecular Therapy, vol. 23, Supplement 1, May 2015, pp. S127-S128.
Vercauteren K, et al. Superior in vivo Transduction of Human Hepatocytes Using Engineered AAV3 Capsid. Mol Ther. Jun. 2016;24(6):1042-9.
Chen M, et al. Efficient Gene Delivery and Expression in Pancreas and Pancreatic Tumors by Capsid-optimized AAV8 Vectors. Hum Gene Ther Methods. Feb. 2017;28(1):49-59.
Ling C, et al. High-Efficiency Transduction of Primary Human Hematopoietic Stem/Progenitor Cells by AAV6 Vectors: Strategies for Overcoming Donor-Variation and Implications in Genome Editing. Sci Rep. Oct. 2016;6:35495.
Earley LF, et al. Identification and Characterization of Nuclear and Nucleolar Localization Signals in the Adeno-Associated Virus Serotype 2 Assembly-Activating Protein. J Virol. Mar. 2015, 89(6):3038-48.
Zou W, et al. Nonstructural protein NP1 of human bocavirus 1 plays a critical role in the expression of viral capsid proteins. J Virol. Apr. 2016;90(9):4658-69.
Mingozzi F, et al. Adeno-associated viral vectors at the frontier between tolerance and immunity. Front Immunol.Mar. 2015, 6:120.
Ling C, et al. Enhanced Transgene Expression from Recombinant Single-Stranded D-Sequence-Substituted Adeno-Associated Virus Vectors in Human Cell Lines In Vitro and in Murine Hepatocytes In Vivo. J Virol. Jan. 2015, 89(2):952-61.
Davidsson M, et al. A novel process of viral vector barcoding and library preparation enables high-diversity library generation and recombination-free paired-end sequencing. Sci Rep. Nov. 2016;6:3563.
Chamberlain K, et al. Expressing transgenes that exceed the packaging capacity of AAV capsids. Hum Gene Ther Methods. Feb. 2016;27(1):1-12.
Dufour, B. D. et al. "Intrajugular Vein Delivery of AAV9-RNAi Prevents Neuropathological Changes and Weight Loss in Huntington's Disease Mice", Molecular Therapy vol. 22,4 (2014): 797-810.

* cited by examiner

COMPOSITIONS AND METHODS OF TREATING HUNTINGTON'S DISEASE

CROSS REFERENCE TO RELATED APPLICATIONS

This application is a 35 U.S.C. § 371 U.S. National Stage Entry of International Application No. PCT/US2018/031117 filed May 4, 2018, which claims priority to U.S. Provisional Patent Application No. 62/501,786, entitled COMPOSITIONS AND METHODS OF TREATING HUNGTINGTON'S DISEASE, filed May 5, 2017, U.S. Provisional Patent Application No. 62/507,921, entitled COMPOSITIONS AND METHODS OF TREATING HUNGTINGTON'S DISEASE, filed May 18, 2017 and U.S. Provisional Patent Application No. 62/520,086, entitled COMPOSITIONS AND METHODS OF TREATING HUNGTINGTON'S DISEASE, filed Jun. 15, 2017; the contents of each of which are herein incorporated by reference in their entirety.

REFERENCE TO SEQUENCE LISTING

The instant application contains a replacement Sequence Listing which has been submitted electronically in ASCII format and is hereby incorporated by reference in its entirety. Said ASCII copy, created on Mar. 11, 2020 is named 2057_1044US371_SL and is 6,706,780 bytes in size.

FIELD OF THE INVENTION

The present invention relates to compositions, methods and processes for the design, preparation, manufacture, use and/or formulation of AAV particles comprising modulatory polynucleotides, e.g., polynucleotides encoding small interfering RNA (siRNA) molecules which target the Huntingtin (HTT) gene (e.g., the wild-type or the mutated CAG-expanded HTT gene). Targeting of the mutated HTT gene may interfere with the HTT gene expression and the resultant HTT protein production. The AAV particles comprising modulatory polynucleotides encoding the siRNA molecules may be inserted into recombinant adeno-associated virus (AAV) vectors. Methods for using the AAV particles to inhibit the HTT gene expression in a subject with a neurodegenerative disease (e.g., Huntington's Disease (HD)) are also disclosed.

BACKGROUND OF THE INVENTION

Huntington's Disease (HD) is a monogenic fatal neurodegenerative disease characterized by progressive chorea, neuropsychiatric and cognitive dysfunction. Huntington's Disease is known to be caused by an autosomal dominant triplet (CAG) repeat expansion which encodes poly-glutamine in the N-terminus of the huntingtin (HTT) protein. This repeat expansion results in a toxic gain of function of HTT and ultimately leads to striatal neurodegeneration which progresses to widespread brain atrophy. Symptoms typically appear between the ages of 35-44 and life expectancy subsequent to onset is 10-25 years. Interestingly, the length of the HTT expansion correlates with both age of onset and rate of disease progression, with longer expansions linked to greater severity of disease. In a small percentage of the HD population (~6%), disease onset occurs from 2-20 years of age with appearance of an akinetic-rigid syndrome. These cases tend to progress faster than those of the later onset variety and have been classified as juvenile or Westphal variant HD. It is estimated that approximately 35,000-70,000 patients are currently suffering from HD in the US and Europe. Currently, only symptomatic relief and supportive therapies are available for treatment of HD, with a cure yet to be identified. Ultimately, individuals with HD succumb to other diseases (e.g., pneumonia, heart failure), choking, suffocation or other complications such as physical injury from falls.

The mechanisms by which CAG-expanded HTT results in neurotoxicity are not well understood. Huntingtin protein is expressed in all cells, though its concentration is highest in the brain. The normal function of HTT is unknown, but in the brains of HD patients, HTT aggregates into abnormal nuclear inclusions. It is now believed that it is this process of misfolding and aggregating along with the associated protein intermediates (i.e. the soluble species and toxic N-terminal fragments) that result in neurotoxicity.

Studies in animal models of HD have suggested that phenotypic reversal is feasible, for example, subsequent to gene shut off in regulated-expression models. Further, animal models in which silencing of HTT was tested, demonstrated promising results with the therapy being both well tolerated and showing potential therapeutic benefit. These findings indicate that HTT silencing may serve as a potential therapeutic target for treatment of HD.

The adeno-associated virus (AAV) is a member of the parvovirus family and has emerged as an attractive vector for gene therapy in large part because this virus is apparently non-pathogenic; in fact, AAV has not been associated with any human disease. Further appeal is due to its ability to transduce dividing and non-diving cells (including efficient transduction of neurons), diminished proinflammatory and immune responses in humans, its inability to autonomously replicate without a helper virus (AAV is a helper-dependent DNA parvovirus which belongs to the genus Dependovirus), and its long-term gene expression. Although over 10 recombinant AAV serotypes (rAAV) have been engineered into vectors, rAAV2 is the most frequently employed serotype for gene therapy trials. Additional rAAV serotypes have been developed and tested in animal models that are more efficient at neuronal transduction.

The present invention develops an AAV particle comprising modulatory polynucleotides encoding novel double stranded RNA (dsRNA) constructs and siRNA constructs and methods of their design, to inhibit or prevent the expression of CAG-expanded HTT in HD patients for treatment of the disease.

SUMMARY OF THE INVENTION

Described herein are methods, processes, compositions kits and devices for the administration of AAV particles comprising modulatory polynucleotides encoding siRNA molecules for the treatment, prophylaxis, palliation and/or amelioration of Huntington's Disease (HD) related symptoms and disorders.

The present invention provides viral genomes comprising modulatory polynucleotides encoding siRNA molecules to target HTT and reduce the expression of HTT in a cell and/or subject.

In some embodiments the viral genome comprises a 5' inverted terminal repeat (ITR) sequence region such as, but not limited to, SEQ ID NO: 1380 and 1381, an enhancer sequence region such as, but not limited to, SEQ ID NO: 1408 and 1409, a promoter sequence region such as, but not limited to, SEQ ID NO: 1410-1411 and the sequence GTTG, at least one intron sequence region such as, but not limited to, SEQ ID NO: 1417-1419, a modulatory polynucleotide sequence region such as, but not limited to, SEQ ID NO: 1183-1279 and 1346-1347, a polyadenylation (polyA) signal sequence region such as, but not limited to, SEQ ID NO: 1420-1423, and a 3' ITR sequence region such as, but not limited to, SEQ ID NO: 1382 and 1383.

In some embodiments, the viral genome may comprise at least one more sequence region.

In one embodiment, the viral genome comprises at least one multiple cloning site (MCS) sequence region such as, but not limited to, SEQ ID NO: 384-1390 and the sequence TCGAG. In one embodiment, the viral genome comprises one MCS sequence region. In one embodiment, the viral genome comprises two MCS sequence regions.

In one embodiment, the viral genome comprises at least one filler sequence region such as, but not limited to, SEQ ID NO: 1390-1407. In one embodiment, the AAV viral genome comprises one filler sequence region. In one embodiment, the AAV viral genome comprises two filler sequence regions.

In one embodiment, the viral genome comprises at least one exon sequence region such as, but not limited to, SEQ ID NO: 1415 and 1416.

In one embodiment, the viral genome comprises one intron sequence region.

In one embodiment, the viral genome comprises two intron sequence regions.

In one embodiment, the viral genome comprises a 5' inverted terminal repeat (ITR) sequence region, an enhancer sequence region, a promoter sequence region, at least one intron sequence region, a modulatory polynucleotide sequence region, a polyadenylation (polyA) signal sequence region, and a 3' ITR sequence region. As a non-limiting example, the AAV viral genome comprises a sequence such as SEQ ID NO: 1352-1379 or a fragment or variant thereof.

In one embodiment, the viral genome such as, but not limited to, any of SEQ ID NO: 1352-1379 or variants having at least 95% identity thereto.

In one embodiment, an AAV particle may comprise a viral genome such as, but not limited to, any of SEQ ID NO: 1352-1379 or variants having at least 95% identity thereto. The AAV particle may comprise a serotype such as, but not limited to, any of the serotypes listed in Table 1.

Provided herein are also pharmaceutical compositions of AAV particles. The AAV particle may comprise a viral genome such as, but not limited to, any of SEQ ID NO: 1352-1379 or variants having at least 95% identity thereto. The AAV particle may comprise a serotype such as, but not limited to, any of the serotypes listed in Table 1.

In some embodiments, the present invention provides methods for inhibiting/silencing HTT gene expression in a cell. The cell may be a neuron (e.g., medium spiny neurons of the putamen, caudate or striatum, and cortical neurons in the cerebral cortex), an astrocyte (e.g., astrocyte in the striatum, cortical astrocytes in the cerebral cortex) and/or oligodendrocytes. As a non-limiting example, the inhibition (or lowering) of the HTT gene expression in the putamen, caudate and cortex reduces the effect of Huntington's Disease in a subject. As another non-limiting example, the inhibition (or lowering) of the HTT gene expression in the medium spiny neurons in the striatum reduces the effect of Huntington's Disease in a subject. As yet another non-limiting example, the inhibition (or lowering) of the HTT gene expression in the astrocytes in the striatum reduces the effect of Huntington's Disease in a subject. In some aspects, the inhibition of the HTT gene expression refers to an inhibition or lowering by at least about 20%, preferably by at least about 30%, 40%, 50%, 60%, 70%, 80%, 85%, 90%, 95% and 100%. Accordingly, the protein product of the targeted gene may be inhibited by at least about 20%, preferably by at least about 30%, 40%, 50%, 60%, 70%, 80%, 85%, 90%, 95% and 100%.

In one embodiment, the present invention provides methods for inhibiting/silencing HTT gene expression by at least about 40% in a cell using the viral genomes comprising the modulatory polynucleotides encoding the siRNA molecules. The cell may be a neuron (e.g., medium spiny neurons of the putamen or striatum, and cortical neurons in the cerebral cortex), an astrocyte (e.g., astrocyte in the striatum, cortical astrocytes in the cerebral cortex) and/or oligodendrocytes. As a non-limiting example, the at least 40% inhibition (or lowering) of the HTT gene expression in the putamen and cortex reduces the effect of Huntington's Disease in a subject. As another non-limiting example, the at least 40% inhibition (or lowering) of the HTT gene expression in the medium spiny neurons in the striatum reduces the effect of Huntington's Disease in a subject. As yet another non-limiting example, the at least 40% inhibition (or lowering) of the HTT gene expression in the astrocytes in the striatum reduces the effect of Huntington's Disease in a subject.

In some embodiments, the present invention provides methods for treating, or ameliorating Huntington's Disease associated with the HTT gene (e.g., CAG-expanded HTT gene) and the resultant HTT protein (e.g., poly-Q protein) in a subject in need of treatment, the method comprising administering to the subject a pharmaceutically effective amount a pharmaceutical composition comprising the AAV particles described herein, and ameliorating symptoms of HD in the subject.

In some embodiments, an AAV particle comprising the nucleic acid sequence encoding at least one siRNA duplex targeting the HTT gene is administered to the subject in need for treating and/or ameliorating HD. The AAV vector serotype may be any of the serotypes listed in Table 1.

In some embodiments, the AAV particles may be introduced directly into the central nervous system of the subject, for example, by intracranial injection.

In some embodiments, the pharmaceutical composition of the present invention is used as a solo therapy. In other embodiments, the pharmaceutical composition of the present invention is used in combination therapy. The combination therapy may be in combination with one or more neuroprotective agents such as small molecule compounds, growth factors and hormones which have been tested for their neuroprotective effect on neuron degeneration.

In some embodiments, the present invention provides methods for treating, or ameliorating Huntington's Disease by administering to a subject in need thereof a therapeutically effective amount of a plasmid or AAV vector described herein.

In some embodiments, the present invention provides a method for inhibiting the expression of the HTT gene in a region of the central nervous system of a subject by administering to the subject a composition with at least one AAV particle which comprises a modulatory polynucleotide encoding an siRNA molecule that, when expressed, inhibits or suppresses the expression of HTT in the subject. The expression may be reduced in a region of the subject such as, but not limited to, the forebrain of a subject or a region of the forebrain such as, but not limited to, the putamen. The expression of HTT in the forebrain or region of the forebrain (e.g., putamen) may be reduced by 40-70%, 40-60%, 50-70%, 50-60%, or it may be reduced by 50%, 51%, 52%, 53%, 54%, 55%, 56%, 57%, 58%, 59%, or 60%.

In some embodiments, the present invention provides a method for treating Huntington's Disease (HD) in a subject in need of treatment. The method may inhibit the expression of the HTT gene in a region of the central nervous system of a subject comprising administering to the subject a composition comprising at least one AAV particle which comprises a modulators polynucleotide encoding an siRNA molecule that, when expressed, inhibits or suppresses the expression of HTT in the subject. The expression may be reduced in a region of the subject such as, but not limited to, the forebrain of a subject or a region of the forebrain such as, but not limited to, the putamen. The expression of HTT in the forebrain or region of the forebrain (e.g., putamen) may be reduced by 40-70%, 40-60%, 50-70%, 50-60%, or it may be reduced by 50%, 51%, 52%, 53%, 54%, 55%, 56%, 57%, 58%, 59%, or 60%.

BRIEF DESCRIPTION OF THE DRAWINGS

The foregoing and other objects, features and advantages will be apparent from the following description of particular embodiments of the invention, as illustrated in the accompanying drawings. The drawings are not necessarily to scale, emphasis instead being placed upon illustrating the principles of various embodiments of the invention.

Figure 1:
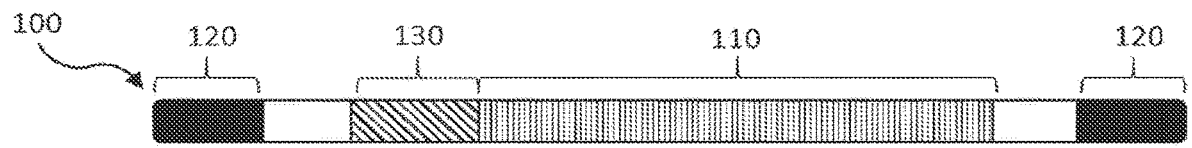
FIG. 1 is a schematic of a viral genome of the invention.

The details of one or more embodiments of the invention are set forth in the accompanying description below. Although any materials and methods similar or equivalent to those described herein can be used in the practice or testing of the present invention, the preferred materials and methods are now described. Other features, objects and advantages of the invention will be apparent from the description. In the description, the singular forms also include the plural unless the context clearly dictates otherwise. Unless defined otherwise, all technical and scientific terms used herein have the same meaning as commonly understood by one of ordinary skill in the art to which this invention belongs. In the case of conflict, the present description will control.

DETAILED DESCRIPTION OF THE INVENTION

I. Compositions of the Invention

According to the present invention, compositions for delivering modulatory polynucleotides and/or modulatory polynucleotide-based compositions by adeno-associated viruses (AAVs) are provided, AAV particles of the invention may be provided via any of several routes of administration, to a cell, tissue, organ, or organism, in vivo, ex vivo or in vitro.

As used herein, an "AAV particle" is a virus which comprises a viral genome with at least one payload region and at least one inverted terminal repeat (ITR) region.

As used herein, "viral genome" or "vector genome" or "viral vector" refers to the nucleic acid sequence(s) encapsulated in an AAV particle. Viral genomes comprise at least one payload region encoding polypeptides or fragments thereof.

As used herein, a "payload" or "payload region" is any nucleic acid molecule which encodes one or more polypeptides of the invention. At a minimum, a payload region comprises nucleic acid sequences that encode a sense and antisense sequence, an siRNA-based composition, or a fragment thereof, but may also optionally comprise one or more functional or regulatory elements to facilitate transcriptional expression and/or polypeptide translation.

The nucleic acid sequences and polypeptides disclosed herein may be engineered to contain modular elements and/or sequence motifs assembled to enable expression of the modulatory polynucleotides and/or modulatory polynucleotide-based compositions of the invention. In some embodiments, the nucleic acid sequence comprising the payload region may comprise one or more of a promoter region, an intron, a Kozak sequence, an enhancer or a polyadenylation sequence. Payload regions of the invention typically encode at least one sense and antisense sequence, an siRNA-based compositions, or fragments of the foregoing in combination with each other or in combination with other polypeptide moieties.

The payload regions of the invention may be delivered to one or more target cells, tissues, organs or organisms within the viral genome of an AAV particle.

Adeno-Associated Viruses (AAVs) and AAV Particles

Viruses of the Parvoviridae family are small non-enveloped icosahedral capsid viruses characterized by a single stranded DNA genome. Parvoviridae family viruses consist of two subfamilies: Parvovirinae, which infect vertebrates, and Densovirinae, which infect invertebrates. Due to its relatively simple structure, easily manipulated using standard molecular biology techniques, this virus family is useful as a biological tool. The genome of the virus may be modified to contain a minimum of components for the assembly of a functional recombinant virus, or viral particle, which is loaded with or engineered to express or deliver a desired payload, which may be delivered to a target cell, tissue, organ, or organism.

The parvoviruses and other members of the Parvoviridae family are generally described in Kenneth I. Berns, "Parvoviridae: The Viruses and Their Replication," Chapter 69 in FIELDS VIROLOGY (3d Ed. 1996), the contents of which are incorporated by reference in their entirety.

The Parvoviridae family comprises the Dependovirus genus which includes adeno-associated viruses (AAV) capable of replication in vertebrate hosts including, but not limited to, human, primate, bovine, canine, equine, and ovine species.

The AAV viral genome is a linear, single-stranded DNA (ssDNA) molecule approximately 5,000 nucleotides (nt) in length. The AAV viral genome can comprise a payload region and at least one inverted terminal repeat (ITR) or ITR region. ITRs traditionally flank the coding nucleotide sequences for the non-structural proteins (encoded by Rep genes) and the structural proteins (encoded by capsid genes or Cap genes). While not wishing to be bound by theory, an AAV viral genome typically comprises two ITR sequences. The AAV viral genome comprises a characteristic T-shaped hairpin structure defined by the self-complementary terminal 145 nt of the 5' and 3' ends of the ssDNA which form an energetically stable double stranded region. The double stranded hairpin structures comprise multiple functions including, but not limited to, acting as an origin for DNA replication by functioning as primers for the endogenous DNA polymerase complex of the host viral replication cell.

In addition to the encoded heterologous payload, AAV vectors may comprise the viral genome, in whole or in part, of any naturally occurring and/or recombinant AAV serotype nucleotide sequence or variant. AAV variants may have sequences of significant homology at the nucleic acid (genome or capsid) and amino acid levels (capsids), to produce constructs which are generally physical and functional equivalents, replicate by similar mechanisms, and assemble by similar mechanisms. Chiorini et al., J. Vir. 71: 6823-33 (1997); Srivastava et al., J. Vir. 45:555-64 (1983); Chiorini et al., J. Vir. 73:1309-1319 (1999); Rutledge et al., J. Vir. 72:309-319 (1998); and Wu et al., J. Vir. 74: 8635-47 (2000), the contents of each of which are incorporated herein by reference in their entirety.

In one embodiment, AAV particles of the present invention are recombinant AAV vectors which are replication defective, lacking sequences encoding functional Rep and Cap proteins within their viral genome. These defective AAV vectors may lack most or all parental coding sequences and essentially carry only one or two AAV ITR sequences and the nucleic acid of interest for delivery to a cell, a tissue, an organ or an organism.

In one embodiment, the viral genome of the AAV particles of the present invention comprise at least one control element which provides for the replication, transcription and translation of a coding sequence encoded therein. Not all of the control elements need always be present as long as the coding sequence is capable of being replicated, transcribed and/or translated in an appropriate host cell. Non-limiting examples of expression control elements include sequences for transcription initiation and/or termination, promoter and/or enhancer sequences, efficient RNA processing signals such as splicing and polyadenylation signals, sequences that stabilize cytoplasmic mRNA, sequences that enhance translation efficacy (e.g., Kozak consensus sequence), sequences that enhance protein stability, and/or sequences that enhance protein processing and/or secretion.

According to the present invention, AAV particles for use in therapeutics and/or diagnostics comprise a virus that has been distilled or reduced to the minimum components necessary for transduction of a nucleic acid payload or cargo of interest. In this manner, AAV particles are engineered as vehicles for specific delivery while lacking the deleterious replication and/or integration features found in wild-type viruses.

AAV vectors of the present invention may be produced recombinantly and may be based on adeno-associated virus (AAV) parent or reference sequences. As used herein, a "vector" is any molecule or moiety which transports, transduces or otherwise acts as a carrier of a heterologous molecule such as the nucleic acids described herein.

In addition to single stranded AAV viral genomes (e.g., ssAAVs), the present invention also provides for self-complementary AAV (scAAVs) viral genomes. scAAV viral genomes contain DNA strands which anneal together to form double stranded DNA. By skipping second strand synthesis, scAAVs allow for rapid expression in the cell.

In one embodiment, the AAV particle of the present invention is an scAAV.

In one embodiment, the AAV particle of the present invention is an ssAAV.

Methods for producing and/or modifying AAV particles are disclosed in the art such as pseudotyped AAV vectors (PCT Patent Publication Nos. WO200028004; WO200123001; WO2004112727; WO 2005005610 and WO 2005072364, the content of each of which is incorporated herein by reference in its entirety).

AAV particles may be modified to enhance the efficiency of delivery. Such modified AAV particles can be packaged efficiently and be used to successfully infect the target cells at high frequency and with minimal toxicity. In some embodiments the capsids of the AAV particles are engineered according to the methods described in US Publication Number US 20130195801, the contents of which are incorporated herein by reference in their entirety.

In one embodiment, the AAV particles comprising a payload region encoding the polypeptides of the invention may be introduced into mammalian cells.

AAV Serotypes

AAV particles of the present invention may comprise or be derived from any natural or recombinant AAV serotype. According to the present invention, the AAV particles may utilize or be based on a serotype selected from any of the following AAV1, AAV2, AAV2G9, AAV3, AAV3a, AAV3b, AAV3-3, AAV4, AAV4-4, AAV5, AAV6, AAV6.1, AAV6.2, AAV6.1.2, AAV7, AAV7.2, AAV8, AAV9, AAV9.11, AAV9.13, AAV9.16, AAV9.24, AAV9.45, AAV9.47, AAV9.61, AAV9.68, AAV9.84, AAV9.9, AAV10, AAV11, AAV12, AAV16.3, AAV24.1, AAV27.3, AAV42.12, AAV42-1b, AAV42-2, AAV42-3a, AAV42-3b, AAV42-4, AAV42-5a, AAV42-5b, AAV42-6b, AAV42-8, AAV42-10, AAV42-11, AAV42-12, AAV42-13, AAV42-15, AAV42-aa, AAV43-1, AAV43-12, AAV43-20, AAV43-21, AAV43-23, AAV43-25, AAV43-5, AAV44.1, AAV44.2, AAV44.5, AAV223.1, AAV223.2, AAV223.4, AAV223.5, AAV223.6, AAV223.7, AAV1-7/rh.48, AAV1-8/rh.49, AAV2-15/rh.62, AAV2-3/rh.61, AAV2-4/rh.50, AAV2-5/rh.51, AAV3.1/hu.6, AAV3.1/hu.9, AAV3-9/rh.52, AAV3-11/rh.53, AAV4-8/r11.64, AAV4-9/rh.54, AAV4-19/rh.55, AAV5-3/rh.57, AAV5-22/rh.58, AAV7.3/hu.7, AAV16.8/hu.10, AAV16.12/hu.11 AAV29.3/bb.1, AAV29.5/bb.2, AAV106.1/hu.37, AAV114.3/hu.40, AAV127.2/hu.41, AAV127.5/hu.42, AAV128.3/hu.44, AAV130.4/hu.48, AAV145.1/hu.53, AAV145.5/hu.54, AAV145.6/hu.55, AAV161.10/hu.60, AAV161.6/hu.61, AAV33.12/hu.17, AAV33.4/hu.15, AAV33.8/hu.16, AAV52/hu.19, AAV52.1/hu.20, AAV58.2/hu.25, AAVA3.3, AAVA3.4, AAVA3.5, AAVA3.7, AAVC1, AAVC2, AAVC5, AAV-DJ, AAV-DJ8, AAVF3, AAVF5, AAVH2, AAVrh.72, AAVhu.8, AAVrh.68, AAVrh.70, AAVpi.1, AAVpi.3, AAVpi.2, AAVrh.60, AAVrh.44, AAVrh.65, AAVrh.55, AAVrh.47, AAVrh.69, AAVrh.45, AAVrh.59, AAVhu.12, AAVH6, AAVLK03, AAVH-1/hu.1, AAVH-5/hu.3, AAVLG-10/rh.40, AAVLG-4/rh.38, AAVLG-9/hu.39, AAVN721-8/rh.43, AAVCh.5, AAVCh.5R1, AAVcy.2, AAVcy.3, AAVcy.4, AAVcy.5, AAVCy.5R1, AAVCy.5R2, AAVCy.5R3, AAVCy.5R4, AAVcy.6, AAVhu.1, AAVhu.2, AAVhu.3, AAVhu.4, AAVhu.5, AAVhu.6, AAVhu.7, AAVhu.9, AAVhu.10, AAVhu.11, AAVhu.13, AAVhu.15, AAVhu.16, AAVhu.17, AAVhu.18, AAVhu.20, AAVhu.21, AAVhu.22, AAVhu.23.2, AAVhu.24, AAVhu.25, AAVhu.27, AAVhu.28, AAVhu.29. AAVhu.29R, AAVhu.31, AAVhu.32, AAVhu.34, AAVhu.35, AAVhu.37, AAVhu.39, AAVhu.40, AAVhu.41, AAVhu.42, AAVhu.43, AAVhu.44, AAVhu.44R1, AAVhu.44R2, AAVhu.44R3, AAVhu.45, AAVhu.46, AAVhu.47, AAVhu.48, AAVhu.48R1, AAVhu.48R2, AAVhu.48R3, AAVhu.49, AAVhu.51, AAVhu.52, AAVhu.54, AAVhu.55, AAVhu.56, AAVhu.57, AAVhu.58, AAVhu.60, AAVhu.61, AAVhu.63, AAVhu.64, AAVhu.66, AAVhu.67, AAVhu.14/9, AAVhu.t 19, AAVrh.2, AAVrh.2R, AAVrh.8, AAVrh.8R, AAVrh.10, AAVrh.12, AAVrh.13, AAVrh.13R, AAVrh.14, AAVrh.17, AAVrh.18, AAVrh.19, AAVrh.20, AAVrh.21, AAVrh.22, AAVrh.23, AAVrh.24, AAVrh.25, AAVrh.31, AAVrh.32, AAVrh.33, AAVrh.34, AAVrh.35, AAVrh.36, AAVrh.37, AAVrh.37R2, AAVrh.38, AAVrh.39, AAVrh.40, AAVrh.46, AAVrh.48, AAVrh.48.1, AAVrh.48.1.2, AAVrh.48.2, AAVrh.49, AAVrh.51, AAVrh.52, AAVrh.53, AAVrh.54, AAVrh.56, AAVrh.57, AAVrh.58, AAVrh.61, AAVrh.64, AAVrh.64R1, AAVrh.64R2, AAVrh.67, AAVrh.73, AAVrh.74, AAVrh8R, AAVrh8R A586R mutant, AAVrh8R R533A mutant, AAAV, BAAV, caprine AAV, bovine AAV, ovine AAV, AAVhE1.1, AAVhEr1.5, AAVhER1.14, AAVhEr1.8, AAVhEr1.16, AAVhEr1.18, AAVhEr1.35, AAVhEr1.7, AAVhEr1.36, AAVhEr2.29, AAVhEr2.4, AAVhEr2.16, AAVhEr2.30, AAVhEr2.31, AAVhEr2.36, AAVhER1.23, AAVhEr3.1, AAV2.5T, AAV-PAEC, AAV-LK01, AAV-LK02, AAV-LK03, AAV-LK04, AAV-LK05, AAV-LK06, AAV-LK07, AAV-LK08, AAV-LK09, AAV-LK10, AAV-LK11, AAV-LK12, AAV-LK13, AAV-LK14, AAV-LK15, AAV-LK16, AAV-LK17, AAV-LK18, AAV-LK19, AAV-PAEC2, AAV-PAEC4, AAV-PAEC6, AAV-PAEC7, AAV-PAEC8, AAV-PAEC11, AAV-PAEC12, AAV-2-pre-miRNA-101, AAV-8h, AAV-8b, AAV-h, AAV-b, AAV SM 10-2, AAV Shuffle 100-1, AAV Shuffle 100-3, AAV Shuffle 100-7, AAV Shuffle 10-2, AAV Shuffle 10-6, AAV Shuffle 10-8, AAV Shuffle 100-2, AAV SM 10-1, AAV SM 10-8, AAV SM 100-3, AAV SM 100-10, BNP61 AAV, BNP62 AAV, BNP63 AAV, AAVrh.50, AAVrh.43, AAVrh.62, AAVrh.48, AAVhu.19, AAVhu.11, AAVhu.53, AAV4-8/rh.64, AAVLG-9/hu.39, AAV54.5/hu.23, AAV54.2/hu.22, AAV54.7/hu.24, AAV54.1/hu.21, AAV54.4R/hu.27, AAV46.2/hu.28, AAV46.6/hu.29, AAV128.1/hu.43, true type AAV (ttAAV), UPENN AAV10, Japanese AAV 10 serotypes, AAV CBr-7.1, AAV CBr-7.10, AAV CBr-7.2, AAV CBr-7.3, AAV CBr-7.4, AAV CBr-7.5, AAV CBr-7.7, AAV CBr-7.8, AAV CBr-B7.3, AAV CBr-B7.4, AAV CBr-E1, AAV CBr-E2, AAV CBr-E3, AAV CBr-E4, AAV CBr-E5, AAV CBr-e5, AAV CBr-E6, AAV CBr-E7, AAV CBr-E8, AAV CHt-1, AAV CHt-2, AAV CHt-3, AAV CHt-6.1, AAV CHt-6.10, AAV CHt-6.5, AAV CHt-6.6, AAV CHt-6.7, AAV CHt-6.8, AAV CHt-P1, AAV CHt-P2, AAV CHt-P5, AAV CHt-P6, AAV CHt-P8, AAV CHt-P9, AAV CKd-1, AAV CKd-10, AAV CKd-2, AAV CKd-3, AAV CKd-4, AAV CKd-6, AAV CKd-7, AAV CKd-8, AAV CKd-B1, AAV CKd-B2, AAV CKd-B3, AAV CKd-B4, AAV CKd-B5, AAV CKd-B6, AAV CKd-B7, AAV CKd-B8, AAV CKd-H1, AAV CKd-H2, AAV CKd-H3, AAV CKd-H4, AAV CKd-H5, AAV CKd-H6, AAV CKd-N3, AAV CKd-N4, AAV CKd-N9, AAV CLg-F1, AAV CLg-F2, AAV CLg-F3, AAV CLg-F4, AAV CLg-F5, AAV CLg-F6, AAV CLg-F7, AAV CLg-F8, AAV CLv-1, AAV CLv1-1, AAV Clv1-10, AAV CLv1-2, AAV CLv-12, AAV CLv1-3, AAV CLv-13, AAV CLv1-4, AAV Clv1-7, AAV Clv1-8, AAV Clv1-9, AAV CLv-2, AAV CLv-3, AAV CLv-4, AAV CLv-6, AAV CLv-8, AAV CLv-D1, AAV CLv-D2, AAV CLv-D3, AAV CLv-D4, AAV CLv-D5, AAV CLv-D6, AAV CLv-D7, AAV CLv-D8, AAV CLv-E1, AAV CLv-K1, AAV CLv-K3, AAV CLv-K6, AAV CLv-L4, AAV CLv-L5, AAV CLv-L6, AAV CLv-M1, AAV CLv-M11, AAV CLv-M2, AAV CLv-M5, AAV CLv-M6, AAV CLv-M7, AAV CLv-M8, AAV CLv-M9, AAV CLv-R1, AAV CLv-R2, AAV CLv-R3, AAV CLv-R4, AAV CLv-R5, AAV CLv-R6, AAV CLv-R7, AAV CLv-R8, AAV CLv-R9, AAV CSp-1, AAV CSp-10, AAV CSp-11, AAV CSp-2, AAV CSp-3, AAV CSp-4, AAV CSp-6, AAV CSp-7, AAV CSp-8, AAV CSp-8.10, AAV CSp-8.2, AAV CSp-8.4, AAV CSp-8.5, AAV CSp-8.6, AAV CSp-8.7, AAV CSp-8.8, AAV CSp-8.9, AAV CSp-9, AAV.hu.48R3, AAV.VR-355, AAV3B, AAV4, AAV5, AAVF1/HSC1, AAVF11/HSC11, AAVF12/HSC12, AAVF13/HSC13, AAVF14/HSC14, AAVF15/HSC15, AAVF16/HSC16, AAVF17/HSC17, AAVF2/HSC2, AAVF3/HSC3, AAVF4/HSC4, AAVF5/HSC5, AAVF6/HSC6, AAVF7/HSC7, AAVF8/HSC8, AAVF9/HSC9, AAV-PHP.B (PHP.B), AAV-PHP.A (PHP.A), G2B-26, G2B-13, THI1.1-32, TH1.1-35, AAVPHP.B2, AAVPHP.B3, AAVPHP.N/PHP.B-DGT, AAVPHP.B-EST, AAVPHP.B-GGT, AAVPHP.B-ATP, AAVPHP.B-ATT-T, AAVPHP.B-DGT-T, AAVPHP.B-GGT-T, AAVPHP.B-SGS, AAVPHP.B-AQP, AAVPHP.B-QQP, AAVPHP.B-SNP(3), AAVPHP.B-SNP, AAVPHP.B-QGT, AAVPHP.B-NQT, AAVPHP.B-EGS, AAVPHP.B-SGN, AAVPHP.B-EGT, AAVPHP.B-DST, AAVPHP.B-DST, AAVPHP.B-STP, AAVPHP.B-PQP, AAVPHP.B-SQP, AAVPHP.B-QLP, AAVPHP.B-TMP, AAVPHP.B-TIP, AAVPHP.S/G2A12, AAVG2A15/G2A3, AAVG2B4, and/or AAVG2B5 and variants thereof.

In some embodiments, the AAV serotype may be, or have, a modification as described in United States Publication No. US 20160361439, the contents of which are herein incorporated by reference in their entirety, such as but not limited to, Y252F, Y272F, Y444F, Y500F, Y700F, Y704F, Y730F, Y275F, Y281F, Y508F, Y576F, Y612G, Y673F, and Y720F of the wild-type AAV1, AAV2, AAV3, AAV4, AAV5, AAV6, AAV7, AAV8, AAV9, AAV10, AAV11, AAV12, and hybrids thereof.

In some embodiments, the AAV serotype may be, or have, a mutation as described in U.S. Pat. No. 9,546,112, the contents of which are herein incorporated by reference in their entirety, such as, but not limited to, at least two, but not all the F129L, D418E, K531E, L584F, V598A and H642N mutations in the sequence of AAV6 (SEQ ID NO:4 of U.S. Pat. No. 9,546,112), AAV1 (SEQ ID NO:6 of U.S. Pat. No. 9,546,112), AAV2, AAV3, AAV4, AAV5, AAV7, AAV9, AAV10 or AAV1 or derivatives thereof. In yet another embodiment, the AAV serotype may be, or have, an AAV6 sequence comprising the K531E mutation (SEQ ID NO:5 of U.S. Pat. No. 9,546,112).

In some embodiments, the AAV serotype may be, or have, a mutation in the AAV1 sequence, as described in in United States Publication No. US 20130224836, the contents of which are herein incorporated by reference in their entirety, such as, but not limited to, at least one of the surface-exposed tyrosine residues, preferably, at positions 252, 273, 445, 701, 705 and 731 of AAV1 (SEQ ID NO: 2 of US 20130224836) substituted with another amino acid, preferably with a phenylalanine residue. In one embodiment, the AAV serotype may be, or have, a mutation in the AAV9 sequence, such as, but not limited to, at least one of the surface-exposed tyrosine residues, preferably, at positions 252, 272, 444, 500, 700, 704 and 730 of AAV2 (SEQ ID NO: 4 of US 20130224836) substituted with another amino acid, preferably with a phenylalanine residue. In one embodiment, the tyrosine residue at position 446 of AAV9 (SEQ ID NO: 6 US 20130224836) is substituted with a phenylalanine residue.

In some embodiments, the serotype may be AAV2 or a variant thereof, as described in International Publication No. WO2016130589, herein incorporated by reference in its entirety. The amino acid sequence of AAV2 may comprise N587A, E548A, or N708A mutations. In one embodiment, the amino acid sequence of any AAV may comprise a V708K mutation.

In some embodiments, the AAV serotype may be, or have, a sequence as described in United States Publication No. US20030138772, the contents of which are herein incorporated by reference in their entirety, such as, but not limited to, AAV1 (SEQ ID NO: 6 and 64 of US20030138772), AAV2 (SEQ ID NO: 7 and 70 of US20030138772), AAV3 (SEQ ID NO: 8 and 71 of US20030138772), AAV4 (SEQ ID NO: 63 of US20030138772), AAV5 (SEQ ID NO: 114 of US20030138772), AAV6 (SEQ ID NO: 65 of US20030138772), AAV7 (SEQ ID NO: 1-3 of US20030138772), AAV8 (SEQ ID NO: 4 and 95 of US20030138772), AAV9 (SEQ ID NO: 5 and 100 of US20030138772), AAV10 (SEQ ID NO: 117 of US20030138772), AAV11 (SEQ ID NO: 118 of US20030138772), AAV12 (SEQ ID NO: 119 of US20030138772), AAVrh10 (amino acids 1 to 738 of SEQ ID NO: 81 of US20030138772), AAV16.3 (US20030138772 SEQ ID NO: 10), AAV29.3/bb.1 (US20030138772 SEQ ID NO: 11), AAV29.4 (US20030138772 SEQ ID NO: 12), AAV29.5/bb.2 (US20030138772 SEQ ID NO: 13), AAV1.3 (US20030138772 SEQ ID NO: 14), AAV13.3 (US20030138772 SEQ ID NO: 15), AAV24.1 (US20030138772 SEQ ID NO: 16), AAV27.3 (US20030138772 SEQ ID NO: 17), AAV7.2 (US20030138772 SEQ ID NO: 18), AAVC1 (US20030138772 SEQ ID NO: 19), AAVC3 (US20030138772 SEQ ID NO: 20), AAVC5 (US20030138772 SEQ ID NO: 21), AAVF1 (US20030138772 SEQ ID NO: 22), AAVF3 (US20030138772 SEQ ID NO: 23), AAVF5 (US20030138772 SEQ ID NO: 24), AAVH6 (US20030138772 SEQ ID NO: 25), AAVH2 (US20030138772 SEQ ID NO: 26), AAV42-8 (US20030138772 SEQ ID NO: 27), AAV42-15 (US20030138772 SEQ ID NO: 28), AAV42-5b (US20030138772 SEQ ID NO: 29), AAV42-1b (US20030138772 SEQ ID NO: 30), AAV42-13 (US20030138772 SEQ ID NO: 31), AAV42-3a (US20030138772 SEQ ID NO: 32), AAV42-4 (US20030138772 SEQ ID NO: 33), AAV42-5a (US20030138772 SEQ ID NO: 34), AAV42-10 (US20030138772 SEQ ID NO: 35), AAV42-3b (US20030138772 SEQ ID NO: 36), AAV42-11 (US20030138772 SEQ ID NO: 37), AAV42-6b (US20030138772 SEQ ID NO: 38), AAV43-1 (US20030138772 SEQ ID NO: 39), AAV43-5 (US20030138772 SEQ ID NO: 40), AAV43-12 (US20030138772 SEQ ID NO: 41), AAV43-20 (US20030138772 SEQ ID NO: 42), AAV43-21 (US20030138772 SEQ ID NO: 43), AAV43-23 (US20030138772 SEQ ID NO: 44), AAV43-25 (US20030138772 SEQ ID NO: 45), AAV44.1 (US20030138772 SEQ ID NO: 46), AAV44.5 (US20030138772 SEQ ID NO: 47), AAV223.1 (US20030138772 SEQ ID NO: 48), AAV223.2 (US20030138772 SEQ ID NO: 49), AAV223.4 (US20030138772 SEQ ID NO: 50), AAV223.5 (US20030138772 SEQ ID NO: 51), AAV223.6 (US20030138772 SEQ ID NO: 52), AAV223.7 (US20030138772 SEQ ID NO: 53), AAVA3.4 (US20030138772 SEQ ID NO: 54), AAVA3.5 (US20030138772 SEQ ID NO: 55), AAVA3.7 (US20030138772 SEQ ID NO: 56), AAVA3.3 (US20030138772 SEQ ID NO: 57), AAV42.12 (US20030138772 SEQ ID NO: 58), AAV44.2 (US20030138772 SEQ ID NO: 59), AAV42-2 (US20030138772 SEQ ID NO: 9), or variants thereof.

In some embodiments, the AAV serotype may be, or have, a sequence as described in United States Publication No. US20150159173, the contents of which are herein incorporated by reference in their entirety, such as, but not limited to, AAV2 (SEQ ID NO: 7 and 23 of US20150159173), rh20 (SEQ ID NO: 1 of US20150159173), rh32/33 (SEQ ID NO: 2 of US20150159173), rh39 (SEQ ID NO: 3, 20 and 36 of US20150159173), rh46 (SEQ ID NO: 4 and 22 of US20150159173), rh73 (SEQ ID NO: 5 of US20150159173), rh74 (SEQ ID NO: 6 of US20150159173), AAV6.1 (SEQ ID NO: 29 of US20150159173), rh.8 (SEQ ID NO: 41 of US20150159173), rh.48.1 (SEQ ID NO: 44 of US20150159173), hu.44 (SEQ ID NO: 45 of US20150159173), hu.29 (SEQ ID NO: 42 of US20150159173), hu.48 (SEQ ID NO: 38 of US20150159173), rh54 (SEQ ID NO: 49 of US20150159173), AAV2 (SEQ ID NO: 7 of US20150159173), cy.5 (SEQ ID NO: 8 and 24 of US20150159173), rh.10 (SEQ ID NO: 9 and 25 of US20150159173), rh.13 (SEQ ID NO: 10 and 26 of US20150159173), AAV1 (SEQ ID NO: 11 and 27 of US20150159173), AAV3 (SEQ ID NO: 12 and 28 of US20150159173), AAV6 (SEQ ID NO: 13 and 29 of US20150159173), AAV7 (SEQ ID NO: 14 and 30 of US20150159173), AAV8 (SEQ ID NO: 15 and 31 of US20150159173), hu.13 (SEQ ID NO: 16 and 32 of US20150159173), hu.26 (SEQ ID NO: 17 and 33 of US20150159173), hu.37 (SEQ ID NO: 18 and 34 of US20150159173), hu.53 (SEQ ID NO: 19 and 35 of US20150159173), rh.43 (SEQ ID NO: 21 and 37 of US20150159173), rh2 (SEQ ID NO: 39 of US20150159173), rh.37 (SEQ ID NO: 40 of US20150159173), rh.64 (SEQ ID NO: 43 of US20150159173), rh.48 (SEQ ID NO: 44 of US20150159173), ch.5 (SEQ ID NO 46 of US20150159173), rh.67 (SEQ ID NO: 47 of US20150159173), rh.58 (SEQ ID NO: 48 of US20150159173), or variants thereof including, but not limited to Cy5R. Cy5R2, Cy5R3, Cy5R4, rh.13R, rh.37R2, rh.2R rh.8R, rh.48.1, rh.48.2, rh.48.1.2, hu.44R1, hu.44R2, hu.44R3, hu.29R, ch.5R1, rh64R1, rh64R2, AAV6.2, AAV6.1, AAV6.12, hu.48R1, hu.48R2, and hu.48R3.

In some embodiments, the AAV serotype may be, or have, a sequence as described in U.S. Pat. No. 7,198,951, the contents of which are herein incorporated by reference in their entirety, such as, but not limited to, AAV9 (SEQ ID NO: 1-3 of U.S. Pat. No. 7,198,951), AAV2 (SEQ ID NO: 4 of U.S. Pat. No. 7,198,951), AAV1 (SEQ ID NO: 5 of U.S. Pat. No. 7,198,951), AAV3 (SEQ ID NO: 6 of U.S. Pat. No. 7,198,951), and AAV8 (SEQ ID NO: 7 of U.S. Pat. No. 7,198,951).

In some embodiments, the AAV serotype may be, or have, a mutation in the AAV9 sequence as described by N Pulicherla et al. (Molecular Therapy 19(6):1070-1078 (2011), herein incorporated by reference in its entirety), such as but not limited to, AAV9.9, AAV9.11, AAV9.13, AAV9.16, AAV9.24, AAV9.45, AAV9.47, AAV9.61, AAV9.68, AAV9.84.

In some embodiments, the AAV serotype may be, or have, a sequence as described in U.S. Pat. No. 6,156,303, the contents of which are herein incorporated by reference in their entirety, such as, but not limited to, AAV3B (SEQ ID NO: 1 and 10 of U.S. Pat. No. 6,156,303), AAV6 (SEQ ID NO: 2, 7 and 11 of U.S. Pat. No. 6,156,303), AAV2 (SEQ ID NO: 3 and 8 of U.S. Pat. No. 6,156,303), AAV3A (SEQ ID NO: 4 and 9, of U.S. Pat. No. 6,156,303), or derivatives thereof.

In some embodiments, the AAV serotype may be, or have, a sequence as described in United States Publication No. US20140359799, the contents of which are herein incorporated by reference in their entirety, such as, but not limited to, AAV8 (SEQ ID NO: 1 of US20140359799), AAVDJ (SEQ ID NO: 2 and 3 of US20140359799), or variants thereof.

In some embodiments, the serotype may be AAVDJ (or AAV-DJ) or a variant thereof, such as AAVDJ8 (or AAV-DJ8), as described by Grimm et al. (Journal of Virology 82(12): 5887-5911 (2008), herein incorporated by reference in its entirety). The amino acid sequence of AAVDJ8 may comprise two or more mutations in order to remove the heparin binding domain (HBD). As a non-limiting example, the AAV-DJ sequence described as SEQ ID NO: 1 in U.S. Pat. No. 7,588,772, the contents of which are herein incorporated by reference in their entirety, may comprise two mutations: (1) R587Q where arginine (R; Arg) at amino acid 587 is changed to glutamine (Q; Gln) and (2) R590T where arginine (R; Arg) at amino acid 590 is changed to threonine (T; Thr). As another non-limiting example, may comprise three mutations: (1) K406R where lysine (K; Lys) at amino acid 406 is changed to arginine (R. Arg), (2) R587Q where arginine (R; Arg) at amino acid 587 is changed to glutamine (Q; Gln) and (3) R590T where arginine (R; Arg) at amino acid 590 is changed to threonine (T; Thr).

In some embodiments, the AAV serotype may be, or have, a sequence of AAV4 as described in International Publication No. WO 1998011244, the contents of which are herein incorporated by reference in their entirety, such as, but not limited to AAV4 (SEQ ID NO: 1-20 of WO1998011244).

In some embodiments, the AAV serotype may be, or have, a mutation in the AAV2 sequence to generate AAV2G9 as described in International Publication No. WO2014144229 and herein incorporated by reference in its entirety.

In some embodiments, the AAV serotype may be, or have, a sequence as described in International Publication No. WO2005033321, the contents of which are herein incorporated by reference in their entirety, such as, but not limited to AAV3-3 (SEQ ID NO: 217 of WO2005033321), AAV1 (SEQ ID NO: 219 and 202 of WO2005033321), AAV106.1/hu.37 (SEQ ID No: 10 of WO2005033321), AAV14.3/hu.40 (SEQ ID No: 11 of WO2005033321), AAV127.2/hu.41 (SEQ ID NO:6 and 8 of WO2005033321), AAV128.3/hu.44 (SEQ ID No: 81 of WO2005033321), AAV130.4/hu.48 (SEQ ID NO: 78 of WO2005033321), AAV145.1/hu.53 (SEQ ID No: 176 and 177 of WO2005033321), AAV145.6/hu.56 (SEQ ID NO: 168 and 192 of WO2005033321), AAV16.12/hu.11 (SEQ ID NO: 153 and 57 of WO2005033321), AAV16.8/hu.10 (SEQ ID NO: 156 and 56 of WO2005033321), AAV161.10/hu.60 (SEQ ID No: 170 of WO2005033321), AAV161.6/hu.61 (SEQ ID No: 174 of WO2005033321), AAV1-7/rh.48 (SEQ ID NO: 32 of WO2005033321), AAV1-8/rh.49 (SEQ ID NOs: 103 and 25 of WO2005033321), AAV2 (SEQ ID NO: 211 and 221 of WO2005033321), AAV2-15/rh.62 (SEQ ID No: 33 and 114 of WO2005033321), AAV2-3/rh.61 (SEQ ID NO: 21 of WO2005033321), AAV2-4/rh.50 (SEQ ID No: 23 and 108 of WO2005033321), AAV2-5/rh.51 (SEQ ID NO: 104 and 22 of WO2005033321), AAV3.1/hu.6 (SEQ ID NO: 5 and 84 of WO2005033321), AAV3.1/hu.9 (SEQ ID NO: 155 and 58 of WO2005033321), AAV3-1 l/rh.53 (SEQ ID NO: 186 and 176 of WO2005033321), AAV3-3 (SEQ ID NO: 200 of WO2005033321), AAV33.12/hu.17 (SEQ ID NO:4 of WO2005033321), AAV33.4/hu.15 (SEQ ID No: 50 of WO2005033321), AAV33.8/hu.16 (SEQ ID No: 51 of WO2005033321), AAV3-9/rh.52 (SEQ ID NO: 96 and 18 of WO02005033321), AAV4-19/rh.55 (SEQ ID NO: 117 of WO2005033321), AAV4-4 (SEQ ID NO: 201 and 218 of WO2005033321), AAV4-9/rh.54 (SEQ ID NO: 116 of WO2005033321), AAV5 (SEQ ID NO: 199 and 216 of WO2005033321), AAV52.1/hu.20 (SEQ ID NO: 63 of WO2005033321), AAV52/hu.19 (SEQ ID NO: 133 of WO2005033321), AAV5-22/rh.58 (SEQ ID No: 27 of WO2005033321), AAV5-3/rh.57 (SEQ ID NO: 105 of WO02005033321), AAV5-3/rh.57 (SEQ ID No: 26 of WO2005033321), AAV58.2/hu.25 (SEQ ID No: 49 of WO2005033321), AAV6 (SEQ ID NO: 203 and 220 of WO2005033321), AAV7 (SEQ ID NO: 222 and 213 of WO2005033321), AAV7.3/hu.7 (SEQ ID No: 55 of WO2005033321), AAV8 (SEQ ID NO: 223 and 214 of WO2005033321), AAVH-1/hu.1 (SEQ ID No: 46 of WO2005033321), AAVH-5/hu.3 (SEQ ID No: 44 of WO2005033321), AAVhu.1 (SEQ ID NO: 144 of WO2005033321), AAVhu.10 (SEQ ID NO: 156 of WO2005033321), AAVhu.11 (SEQ ID NO: 153 of WO2005033321), AAVhu.12 (WO2005033321 SEQ ID NO: 59), AAVhu.13 (SEQ ID NO: 129 of WO2005033321), AAVhu.14/AAV9 (SEQ ID NO: 123 and 3 of WO2005033321), AAVhu.15 (SEQ ID NO: 147 of WO2005033321), AAVhu.16 (SEQ ID NO: 148 of WO2005033321), AAVhu.17 (SEQ ID NO: 83 of WO2005033321), AAVhu.18 (SEQ ID NO: 149 of WO2005033321), AAVhu.19 (SEQ ID NO: 133 of WO2005033321), AAVhu.2 (SEQ ID NO: 143 of WO2005033321), AAVhu.20 (SEQ ID NO: 134 of WO2005033321), AAVhu.21 (SEQ ID NO: 135 of WO2005033321), AAVhu.22 (SEQ ID NO: 138 of WO2005033321), AAVhu.23.2 (SEQ ID NO: 137 of WO2005033321), AAVhu.24 (SEQ ID NO: 136 of WO2005033321), AAVhu.25 (SEQ ID NO: 146 of WO2005033321), AAVhu.27 (SEQ ID NO: 140 of WO2005033321), AAVhu.29 (SEQ ID NO: 132 of WO2005033321), AAVhu.3 (SEQ ID NO: 145 of WO2005033321), AAVhu.31 (SEQ ID NO: 121 of WO2005033321), AAVhu.32 (SEQ ID NO: 122 of WO2005033321), AAVhu.34 (SEQ ID NO: 125 of WO2005033321), AAVhu.35 (SEQ ID NO: 164 of WO2005033321), AAVhu.37 (SEQ ID NO: 88 of WO2005033321), AAVhu.39 (SEQ ID NO: 102 of WO2005033321), AAVhu.4 (SEQ ID NO: 141 of WO2005033321), AAVhu.40 (SEQ ID NO: 87 of WO2005033321), AAVhu.41 (SEQ ID NO: 91 of WO2005033321), AAVhu.42 (SEQ ID NO: 85 of WO2005033321), AAVhu.43 (SEQ ID NO: 160 of WO2005033321), AAVhu.44 (SEQ ID NO: 144 of WO2005033321), AAVhu.45 (SEQ ID NO: 127 of WO2005033321), AAVhu.46 (SEQ ID NO: 159 of WO2005033321), AAVhu.47 (SEQ ID NO: 128 of WO2005033321), AAVhu.48 (SEQ ID NO: 157 of WO2005033321), AAVhu.49 (SEQ ID NO: 189 of WO2005033321), AAVhu.51 (SEQ ID NO: 190 of WO2005033321), AAVhu.52 (SEQ ID NO: 191 of WO2005033321), AAVhu.53 (SEQ ID NO: 186 of WO2005033321), AAVhu.54 (SEQ ID NO: 188 of WO2005033321), AAVhu.55 (SEQ ID NO: 187 of WO2005033321), AAVhu.56 (SEQ ID NO: 192 of WO2005033321), AAVhu.57 (SEQ ID NO: 193 of WO2005033321), AAVhu.58 (SEQ ID NO: 194 of WO2005033321), AAVhu.6 (SEQ ID NO: 84 of WO2005033321), AAVhu.60 (SEQ ID NO: 184 of WO2005033321), AAVhu.61 (SEQ ID NO: 185 of WO2005033321), AAVhu.63 (SEQ ID NO: 195 of WO2005033321), AAVhu.64 (SEQ ID NO: 196 of WO2005033321), AAVhu.66 (SEQ ID NO: 197 of WO2005033321), AAVhu.67 (SEQ ID NO: 198 of WO2005033321), AAVhu.7 (SEQ ID NO: 150 of WO2005033321), AAVhu.8 (WO2005033321 SEQ ID NO: 12), AAVhu.9 (SEQ ID NO: 155 of WO2005033321), AAVLG-10/rh.40 (SEQ ID No: 14 of WO2005033321), AAVLG-4/rh.38 (SEQ ID NO: 86 of WO2005033321), AAVLG-4/rh.38 (SEQ ID No: 7 of WO2005033321), AAVN721-8/rh.43 (SEQ ID NO: 163 of WO2005033321), AAVN721-8/rh.43 (SEQ ID No: 43 of WO2005033321), AAVpi.1 (WO2005033321 SEQ ID NO: 28), AAVpi.2 (WO2005033321 SEQ ID NO: 30), AAVpi.3 (WO2005033321 SEQ ID NO: 29), AAVrh.38 (SEQ ID NO: 86 of WO2005033321), AAVrh.40 (SEQ ID NO: 92 of WO2005033321), AAVrh.43 (SEQ ID NO: 163 of WO2005033321), AAVrh.44 (WO2005033321 SEQ ID NO: 34), AAVrh.45 (WO2005033321 SEQ ID NO: 41), AAVrh.47 (WO2005033321 SEQ ID NO: 38), AAVrh.48 (SEQ ID NO: 115 of WO2005033321), AAVrh.49 (SEQ ID NO: 103 of WO2005033321), AAVrh.50 (SEQ ID NO: 108 of WO2005033321), AAVrh.51 (SEQ ID NO: 104 of WO2005033321), AAVrh.52 (SEQ ID NO: 96 of WO2005033321), AAVrh.53 (SEQ ID NO: 97 of WO02005033321), AAVrh.55 (WO2005033321 SEQ ID NO: 37), AAVrh.56 (SEQ ID NO: 152 of WO2005033321), AAVrh.57 (SEQ ID NO: 105 of WO2005033321), AAVrh.58 (SEQ ID NO: 106 of WO2005033321), AAVrh.59 (WO2005033321 SEQ ID NO: 42), AAVrh.60 (WO2005033321 SEQ ID NO: 31), AAVrh.61 (SEQ ID NO: 107 of WO02005033321), AAVrh.62 (SEQ ID NO: 114 of WO2005033321), AAVrh.64 (SEQ ID NO: 99 of WO2005033321), AAVrh.65 (WO2005033321 SEQ ID NO: 35), AAVrh.68 (WO2005033321 SEQ ID NO: 16), AAVrh.69 (WO2005033321 SEQ ID NO: 39), AAVrh.70 (WO2005033321 SEQ ID NO: 20), AAVrh.72 (WO2005033321 SEQ ID NO: 9), or variants thereof including, but not limited to, AAVcy.2, AAVcy.3, AAVcy.4, AAVcy.5, AAVcy.6, AAVrh.12, AAVrh.17, AAVrh.18, AAVrh.19, AAVrh.21, AAVrh.22, AAVrh.23, AAVrh.24, AAVrh.25, AAVrh.25/42 15, AAVrh.31, AAVrh.32, AAVrh.33, AAVrh.34, AAVrh.35, AAVrh.36, AAVrh.37, AAVrh14. Non limiting examples of variants include SEQ ID NO: 13, 15, 17, 19, 24, 36, 40, 45, 47, 48, 51-54, 60-62, 64-77, 79, 80, 82, 89, 90, 93-95, 98, 100, 101, 109-113, 118-120, 124, 126, 131, 139, 142, 151, 154, 158, 161, 162, 165-183, 202, 204-212, 215, 219, 224-236, of WO02005033321, the contents of which are herein incorporated by reference in their entirety.

In some embodiments, the AAV serotype may be, or have, a sequence as described in International Publication No. WO2015168666, the contents of which are herein incorporated by reference in their entirety, such as, but not limited to, AAVrh8R (SEQ ID NO: 9 of WO2015168666), AAVrh8R A586R mutant (SEQ ID NO: 10 of WO2015168666), AAVrh8R R533A mutant (SEQ ID NO: 11 of WO2015168666), or variants thereof.

In some embodiments, the AAV serotype may be, or have, a sequence as described in U.S. Pat. No. 9,233,131, the contents of which are herein incorporated by reference in their entirety, such as, but not limited to, AAVhE1.1 (SEQ ID NO:44 of U.S. Pat. No. 9,233,131), AAVhEr1.5 (SEQ ID NO:45 of U.S. Pat. No. 9,233,131), AAVhER1.14 (SEQ ID NO:46 of U.S. Pat. No. 9,233,131), AAVhEr1.8 (SEQ ID NO:47 of U.S. Pat. No. 9,233,131), AAVhEr1.16 (SEQ ID NO:48 of U.S. Pat. No. 9,233,131), AAVhEr1.18 (SEQ ID NO:49 of U.S. Pat. No. 9,233,131), AAVhEr1.35 (SEQ ID NO:50 of U.S. Pat. No. 9,233,131), AAVhEr1.7 (SEQ ID NO:51 of U.S. Pat. No. 9,233,131), AAVhEr1.36 (SEQ ID NO:52 of U.S. Pat. No. 9,233,131), AAVhEr2.29 (SEQ ID NO:53 of U.S. Pat. No. 9,233,131), AAVhEr2.4 (SEQ ID NO:54 of U.S. Pat. No. 9,233,131), AAVhEr2.16 (SEQ ID NO:55 of U.S. Pat. No. 9,233,131), AAVhEr2.30 (SEQ ID NO:56 of U.S. Pat. No. 9,233,131), AAVhEr2.31 (SEQ ID NO:58 of U.S. Pat. No. 9,233,131), AAVhEr2.36 (SEQ ID NO:57 of U.S. Pat. No. 9,233,131), AAVhER1.23 (SEQ ID NO:53 of U.S. Pat. No. 9,233,131), AAVhEr3.1 (SEQ ID NO:59 of U.S. Pat. No. 9,233,131), AAV2.5T (SEQ ID NO:42 of U.S. Pat. No. 9,233,131), or variants thereof.

In some embodiments, the AAV serotype may be, or have, a sequence as described in United States Patent Publication No. US20150376607, the contents of which are herein incorporated by reference in their entirety, such as, but not limited to, AAV-PAEC (SEQ ID NO:1 of US20150376607), AAV-LK01 (SEQ ID NO:2 of US20150376607), AAV-LK02 (SEQ ID NO:3 of US20150376607), AAV-LK03 (SEQ ID NO:4 of US20150376607), AAV-LK04 (SEQ ID NO:5 of US20150376607), AAV-LK05 (SEQ ID NO:6 of US20150376607), AAV-LK06 (SEQ ID NO:7 of US20150376607), AAV-LK07 (SEQ ID NO:8 of US20150376607), AAV-LK08 (SEQ ID NO:9 of US20150376607), AAV-LK09 (SEQ ID NO: 10 of US20150376607), AAV-LK10 (SEQ ID NO: 11 of US20150376607), AAV-LK11 (SEQ ID NO:12 of US20150376607), AAV-LK12 (SEQ ID NO: 13 of US20150376607), AAV-LK13 (SEQ ID NO: 14 of US20150376607), AAV-LK14 (SEQ ID NO: 15 of US20150376607), AAV-LK15 (SEQ ID NO:16 of US20150376607), AAV-LK16 (SEQ ID NO: 17 of US20150376607), AAV-LK17 (SEQ ID NO: 18 of US20150376607), AAV-LK18 (SEQ ID NO: 19 of US20150376607), AAV-LK19 (SEQ ID NO:20 of US20150376607), AAV-PAEC2 (SEQ ID NO:21 of US20150376607), AAV-PAEC4 (SEQ ID NO:22 of US20150376607), AAV-PAEC6 (SEQ ID NO:23 of US20150376607), AAV-PAEC7 (SEQ ID NO:24 of US20150376607), AAV-PAEC8 (SEQ ID NO:25 of US20150376607), AAV-PAEC1 (SEQ ID NO:26 of US20150376607), AAV-PAEC12 (SEQ ID NO:27, of US20150376607), or variants thereof.

In some embodiments, the AAV serotype may be, or have, a sequence as described in U.S. Pat. No. 9,163,261, the contents of which are herein incorporated by reference in their entirety, such as, but not limited to, AAV-2-pre-miRNA-101 (SEQ ID NO: 1 U.S. Pat. No. 9,163,261), or variants thereof.

In some embodiments, the AAV serotype may be, or have, a sequence as described in United States Patent Publication No. US20150376240, the contents of which are herein incorporated by reference in their entirety, such as, but not limited to, AAV-8h (SEQ ID NO: 6 of US20150376240), AAV-8b (SEQ ID NO: 5 of US20150376240), AAV-h (SEQ ID NO: 2 of US20150376240), AAV-b (SEQ ID NO: 1 of US20150376240), or variants thereof.

In some embodiments, the AAV serotype may be, or have, a sequence as described in United States Patent Publication No. US20160017295, the contents of which are herein incorporated by reference in their entirety, such as, but not limited to, AAV SM 10-2 (SEQ ID NO: 22 of US20160017295), AAV Shuffle 100-1 (SEQ ID NO: 23 of US20160017295), AAV Shuffle 100-3 (SEQ ID NO: 24 of US20160017295), AAV Shuffle 100-7 (SEQ ID NO: 25 of US20160017295), AAV Shuffle 10-2 (SEQ ID NO: 34 of US20160017295), AAV Shuffle 10-6 (SEQ ID NO: 35 of US20160017295), AAV Shuffle 10-8 (SEQ ID NO: 36 of US20160017295), AAV Shuffle 100-2 (SEQ ID NO: 37 of US20160017295), AAV SM 10-1 (SEQ ID NO: 38 of US20160017295), AAV SM 10-8 (SEQ ID NO: 39 of US20160017295), AAV SM 100-3 (SEQ ID NO: 40 of US20160017295), AAV SM 100-10 (SEQ ID NO: 41 of US20160017295), or variants thereof.

In some embodiments, the AAV serotype may be, or have, a sequence as described in United States Patent Publication No. US20150238550, the contents of which are herein incorporated by reference in their entirety, such as, but not limited to, BNP61 AAV (SEQ ID NO: 1 of US20150238550), BNP62 AAV (SEQ ID NO: 3 of US20150238550), BNP63 AAV (SEQ ID NO: 4 of US20150238550), or variants thereof.

In some embodiments, the AAV serotype may be or may have a sequence as described in United States Patent Publication No. US20150315612, the contents of which are herein incorporated by reference in their entirety, such as, but not limited to, AAVrh.50 (SEQ ID NO: 108 of US20150315612), AAVrh.43 (SEQ ID NO: 163 of US20150315612), AAVrh.62 (SEQ ID NO: 114 of US20150315612), AAVrh.48 (SEQ ID NO: 115 of US20150315612), AAVhu.19 (SEQ ID NO: 133 of US20150315612), AAVhu.11 (SEQ ID NO: 153 of US20150315612), AAVhu.53 (SEQ ID NO: 186 of US20150315612), AAV4-8/rh.64 (SEQ ID No: 15 of US20150315612), AAVLG-9/hu.39 (SEQ ID No: 24 of US20150315612), AAV54.5/hu.23 (SEQ ID No: 60 of US20150315612), AAV54.2/hu.22 (SEQ ID No: 67 of US20150315612), AAV54.7/hu.24 (SEQ ID No: 66 of US20150315612), AAV54.1/hu.21 (SEQ ID No: 65 of US20150315612), AAV54.4R/hu.27 (SEQ ID No: 64 of US20150315612), AAV46.2/hu.28 (SEQ ID No: 68 of US20150315612), AAV46.6/hu.29 (SEQ ID No: 69 of US20150315612), AAV128.1/hu.43 (SEQ ID No: 80 of US20150315612), or variants thereof.

In some embodiments, the AAV serotype may be, or have, a sequence as described in International Publication No. WO2015121501, the contents of which are herein incorporated by reference in their entirety, such as, but not limited to, true type AAV (ttAAV) (SEQ ID NO: 2 of WO2015121501), "UPenn AAV10" (SEQ ID NO: 8 of WO2015121501), "Japanese AAV10" (SEQ ID NO: 9 of WO2015121501), or variants thereof.

According to the present invention, AAV capsid serotype selection or use may be from a variety of species. In one embodiment, the AAV may be an avian AAV (AAAV). The AAAV serotype may be, or have, a sequence as described in U.S. Pat. No. 9,238,800, the contents of which are herein incorporated by reference in their entirety, such as, but not limited to, AAAV (SEQ ID NO: 1, 2, 4, 6, 8, 10, 12, and 14 of U.S. Pat. No. 9,238,800), or variants thereof.

In one embodiment, the AAV may be a bovine AAV (BAAV). The BAAV serotype may be, or have, a sequence as described in U.S. Pat. No. 9,193,769, the contents of which are herein incorporated by reference in their entirety, such as, but not limited to, BAAV (SEQ ID NO: 1 and 6 of U.S. Pat. No. 9,193,769), or variants thereof. The BAAV serotype may be or have a sequence as described in U.S. Pat. No. 7,427,396, the contents of which are herein incorporated by reference in their entirety, such as, but not limited to, BAAV (SEQ ID NO: 5 and 6 of U.S. Pat. No. 7,427,396), or variants thereof.

In one embodiment, the AAV may be a caprine AAV. The caprine AAV serotype may be, or have, a sequence as described in U.S. Pat. No. 7,427,396, the contents of which are herein incorporated by reference in their entirety, such as, but not limited to, caprine AAV (SEQ ID NO: 3 of U.S. Pat. No. 7,427,396), or variants thereof.

In other embodiments the AAV may be engineered as a hybrid AAV from two or more parental serotypes. In one embodiment, the AAV may be AAV2G9 which comprises sequences from AAV2 and AAV9. The AAV2G9 AAV serotype may be, or have, a sequence as described in United States Patent Publication No. US20160017005, the contents of which are herein incorporated by reference in its entirety.

In one embodiment, the AAV may be a serotype generated by the AAV9 capsid library with mutations in amino acids 390-627 (VP1 numbering) as described by Pulicherla et al. (Molecular Therapy 19(6): 1070-1078 (2011), the contents of which are herein incorporated by reference in their entirety. The serotype and corresponding nucleotide and amino acid substitutions may be, but is not limited to, AAV9.1 (G1594C; D532H), AAV6.2 (T1418A and T1436X; V473D and 1479K), AAV9.3 (T1238A; F413Y), AAV9.4 (T1250C and A1617T; F417S), AAV9.5 (A1235G, A1314T, A1642G, C1760T; Q412R, T548A, A587V), AAV9.6 (T1231A; F411I), AAV9.9 (G1203A, G1785T; W595C), AAV9.10 (A1500G, T1676C; M559T), AAV9.11 (A1425T, A1702C, A1769T; T568P, Q590L), AAV9.13 (A1369C, A1720T; N457H, T574S), AAV9.14 (T1340A, T1362C, T1560C, G1713A; L447H), AAV9.16 (A1775T; Q592L), AAV9.24 (T1507C, T1521G; W503R), AAV9.26 (A1337G, A1769C; Y446C, Q590P), AAV9.33 (A1667C; D556A), AAV9.34 (A1534G, C1794T; N512D), AAV9.35 (A1289T, T1450A, C1494T, A1515T, C1794A, G1816A; Q430L, Y484N, N98K, V606I), AAV9.40 (A1694T, E565V), AAV9.41 (A1348T, T1362C; T450S), AAV9.44 (A1684C, A1701T, A1737G; N562H, K567N), AAV9.45 (A1492T, C1804T; N498Y, L602F), AAV9.46 (G1441C, T1525C, T1549G; G481R, W509R, L517V), 9.47 (G1241A, G1358A, A1669G, C1745T; S414N, G453D, K557E, T582I), AAV9.48 (C1445T, A1736T; P482L, Q579L), AAV9.50 (A1638T, C1683T, T1805A; Q546H, L602H), AAV9.53 (G1301A, A1405C, C1664T, G1811 T; R134Q, S469R, A555V, G604V), AAV9.54 (C1531A, T1609A; L511I, L537M), AAV9.55 (T1605A; F535L), AAV9.58 (C1475T, C1579A; T492I, H527N), AAV.59 (T1336C; Y446H), AAV9.61 (A1493T; N498I), AAV9.64 (C1531A, A1617T; L511I), AAV9.65 (C1335T, T1530C, C1568A; A523D), AAV9.68 (C1510A; P504T), AAV9.80 (G1441A; G481R), AAV9.83 (C1402A, A1500T; P468T, E500D), AAV9.87 (T1464C, T1468C; S490P), AAV9.90 (A1196T; Y399F), AAV9.91 (T1316G, A1583T, C1782G, T1806C; L439R K528I), AAV9.93 (A1273G, A1421G, A1638C, C1712T, G1732A, A1744T, A1832T; S425G, Q474R, Q546H, P571L, G578R, T582S, D61 IV), AAV9.94 (A1675T; M559L) and AAV9.95 (T1605A; F535L).

In some embodiments, the AAV serotype may be, or have, a sequence as described in International Publication No. WO2016049230, the contents of which are herein incorporated by reference in their entirety, such as, but not limited to AAVF1/HSC1 (SEQ ID NO: 2 and 20 of WO2016049230), AAVF2/HSC2 (SEQ ID NO: 3 and 21 of WO2016049230), AAVF3/HSC3 (SEQ ID NO: 5 and 22 of WO2016049230), AAVF4/HSC4 (SEQ ID NO: 6 and 23 of WO2016049230), AAVF5/HSC5 (SEQ ID NO: 11 and 25 of WO2016049230), AAVF6/HSC6 (SEQ ID NO: 7 and 24 of WO2016049230), AAVF7/HSC7 (SEQ ID NO: 8 and 27 of WO2016049230), AAVF8/HSC8 (SEQ ID NO: 9 and 28 of WO02016049230), AAVF9/HSC9 (SEQ ID NO: 10 and 29 of WO2016049230), AAVF11/HSC11 (SEQ ID NO: 4 and 26 of WO2016049230), AAVF12/HSC12 (SEQ ID NO: 12 and 30 of WO2016049230), AAVF13/HSC13 (SEQ ID NO: 14 and 31 of WO2016049230), AAVF14/HSC14 (SEQ ID NO: 15 and 32 of WO2016049230), AAVF15/HSC15 (SEQ ID NO: 16 and 33 of WO2016049230), AAVF16/HSC16 (SEQ ID NO: 17 and 34 of WO2016049230), AAVF17/HSC17 (SEQ ID NO: 13 and 35 of WO2016049230), or variants or derivatives thereof.

In some embodiments, the AAV serotype may be, or have, a sequence as described in U.S. Pat. No. 8,734,809, the contents of which are herein incorporated by reference in their entirety, such as, but not limited to, AAV CBr-E1 (SEQ ID NO: 13 and 87 of U.S. Pat. No. 8,734,809), AAV CBr-E2 (SEQ ID NO: 14 and 88 of U.S. Pat. No. 8,734,809), AAV CBr-E3 (SEQ ID NO: 15 and 89 of U.S. Pat. No. 8,734,809), AAV CBr-E4 (SEQ ID NO: 16 and 90 of U.S. Pat. No. 8,734,809), AAV CBr-E5 (SEQ ID NO: 17 and 91 of U.S. Pat. No. 8,734,809), AAV CBr-e5 (SEQ ID NO: 18 and 92 of U.S. Pat. No. 8,734,809), AAV CBr-E6 (SEQ ID NO: 19 and 93 of U.S. Pat. No. 8,734,809), AAV CBr-E7 (SEQ ID NO: 20 and 94 of U.S. Pat. No. 8,734,809), AAV CBr-E8 (SEQ ID NO: 21 and 95 of U.S. Pat. No. 8,734,809), AAV CLv-D1 (SEQ ID NO: 22 and 96 of U.S. Pat. No. 8,734,809), AAV CLv-D2 (SEQ ID NO: 23 and 97 of U.S. Pat. No. 8,734,809), AAV CLv-D3 (SEQ ID NO: 24 and 98 of U.S. Pat. No. 8,734,809), AAV CLv-D4 (SEQ ID NO: 25 and 99 of U.S. Pat. No. 8,734,809), AAV CLv-D5 (SEQ ID NO: 26 and 100 of U.S. Pat. No. 8,734,809), AAV CLv-D6 (SEQ ID NO: 27 and 101 of U.S. Pat. No. 8,734,809), AAV CLv-D7 (SEQ ID NO: 28 and 102 of U.S. Pat. No. 8,734,809), AAV CLv-D8 (SEQ ID NO: 29 and 103 of U.S. Pat. No. 8,734,809), AAV CLv-E1 (SEQ ID NO: 13 and 87 of U.S. Pat. No. 8,734,809), AAV CLv-R1 (SEQ ID NO: 30 and 104 of U.S. Pat. No. 8,734,809), AAV CLv-R2 (SEQ ID NO: 31 and 105 of U.S. Pat. No. 8,734,809), AAV CLv-R3 (SEQ ID NO: 32 and 106 of U.S. Pat. No. 8,734,809), AAV CLv-R4 (SEQ ID NO: 33 and 107 of U.S. Pat. No. 8,734,809), AAV CLv-R5 (SEQ ID NO: 34 and 108 of U.S. Pat. No. 8,734,809), AAV CLv-R6 (SEQ ID NO: 35 and 109 of U.S. Pat. No. 8,734,809), AAV CLv-R7 (SEQ ID NO: 36 and 110 of U.S. Pat. No. 8,734,809), AAV CLv-R8 (SEQ ID NO: 37 and 111 of U.S. Pat. No. 8,734,809), AAV CLv-R9 (SEQ ID NO: 38 and 112 of US8734809), AAV CLg-F1 (SEQ ID NO: 39 and 113 of U.S. Pat. No. 8,734,809), AAV CLg-F2 (SEQ ID NO: 40 and 114 of U.S. Pat. No. 8,734,809), AAV CLg-F3 (SEQ ID NO: 41 and 115 of U.S. Pat. No. 8,734,809), AAV CLg-F4 (SEQ ID NO: 42 and 116 of U.S. Pat. No. 8,734,809), AAV CLg-F5 (SEQ ID NO: 43 and 117 of U.S. Pat. No. 8,734,809), AAV CLg-F6 (SEQ ID NO: 43 and 117 of U.S. Pat. No. 8,734,809), AAV CLg-F7 (SEQ ID NO: 44 and 118 of U.S. Pat. No. 8,734,809), AAV CLg-F8 (SEQ ID NO: 43 and 117 of U.S. Pat. No. 8,734,809), AAV CSp-1 (SEQ ID NO: 45 and 119 of U.S. Pat. No. 8,734,809), AAV CSp-10 (SEQ ID NO: 46 and 120 of U.S. Pat. No. 8,734,809), AAV CSp-11 (SEQ ID NO: 47 and 121 of U.S. Pat. No. 8,734,809), AAV CSp-2 (SEQ ID NO: 48 and 122 of U.S. Pat. No. 8,734,809), AAV CSp-3 (SEQ ID NO: 49 and 123 of U.S. Pat. No. 8,734,809), AAV CSp-4 (SEQ ID NO: 50 and 124 of U.S. Pat. No. 8,734,809), AAV CSp-6 (SEQ ID NO: 51 and 125 of U.S. Pat. No. 8,734,809), AAV CSp-7 (SEQ ID NO: 52 and 126 of U.S. Pat. No. 8,734,809), AAV CSp-8 (SEQ ID NO: 53 and 127 of U.S. Pat. No. 8,734,809), AAV CSp-9 (SEQ ID NO: 54 and 128 of U.S. Pat. No. 8,734,809), AAV CHt-2 (SEQ ID NO: 55 and 129 of U.S. Pat. No. 8,734,809), AAV CHt-3 (SEQ ID NO: 56 and 130 of U.S. Pat. No. 8,734,809), AAV CKd-1 (SEQ ID NO: 57 and 131 of U.S. Pat. No. 8,734,809), AAV CKd-10 (SEQ ID NO: 58 and 132 of U.S. Pat. No. 8,734,809), AAV CKd-2 (SEQ ID NO: 59 and 133 of U.S. Pat. No. 8,734,809), AAV CKd-3 (SEQ ID NO: 60 and 134 of U.S. Pat. No. 8,734,809), AAV CKd-4 (SEQ ID NO: 61 and 135 of U.S. Pat. No. 8,734,809), AAV CKd-6 (SEQ ID NO: 62 and 136 of U.S. Pat. No. 8,734,809), AAV CKd-7 (SEQ ID NO: 63 and 137 of U.S. Pat. No. 8,734,809), AAV CKd-8 (SEQ ID NO: 64 and 138 of U.S. Pat. No. 8,734,809), AAV CLv-1 (SEQ ID NO: 35 and 139 of U.S. Pat. No. 8,734,809), AAV CLv-12 (SEQ ID NO: 66 and 140 of U.S. Pat. No. 8,734,809), AAV CLv-13 (SEQ ID NO: 67 and 141 of U.S. Pat. No. 8,734,809), AAV CLv-2 (SEQ ID NO: 68 and 142 of U.S. Pat. No. 8,734,809), AAV CLv-3 (SEQ ID NO: 69 and 143 of U.S. Pat. No. 8,734,809), AAV CLv-4 (SEQ ID NO: 70 and 144 of U.S. Pat. No. 8,734,809), AAV CLv-6 (SEQ ID NO: 71 and 145 of U.S. Pat. No. 8,734,809), AAV CLv-8 (SEQ ID NO: 72 and 146 of U.S. Pat. No. 8,734,809), AAV CKd-B1 (SEQ ID NO: 73 and 147 of U.S. Pat. No. 8,734,809), AAV CKd-B2 (SEQ ID NO: 74 and 148 of U.S. Pat. No. 8,734,809), AAV CKd-B3 (SEQ ID NO: 75 and 149 of U.S. Pat. No. 8,734,809), AAV CKd-B4 (SEQ ID NO: 76 and 150 of U.S. Pat. No. 8,734,809), AAV CKd-B5 (SEQ ID NO: 77 and 151 of U.S. Pat. No. 8,734,809), AAV CKd-B6 (SEQ ID NO: 78 and 152 of U.S. Pat. No. 8,734,809), AAV CKd-B7 (SEQ ID NO: 79 and 153 of U.S. Pat. No. 8,734,809), AAV CKd-B8 (SEQ ID NO: 80 and 154 of U.S. Pat. No. 8,734,809), AAV CKd-H1 (SEQ ID NO: 81 and 155 of U.S. Pat. No. 8,734,809), AAV CKd-H2 (SEQ ID NO: 82 and 156 of U.S. Pat. No. 8,734,809), AAV CKd-H3 (SEQ ID NO: 83 and 157 of U.S. Pat. No. 8,734,809), AAV CKd-H4 (SEQ ID NO: 84 and 158 of U.S. Pat. No. 8,734,809), AAV CKd-H5 (SEQ ID NO: 85 and 159 of U.S. Pat. No. 8,734,809), AAV CKd-H6 (SEQ ID NO: 77 and 151 of U.S. Pat. No. 8,734,809), AAV CHt-1 (SEQ ID NO: 86 and 160 of U.S. Pat. No. 8,734,809), AAV CLv1-1 (SEQ ID NO: 171 of U.S. Pat. No. 8,734,809), AAV CLv1-2 (SEQ ID NO: 172 of U.S. Pat. No. 8,734,809), AAV CLv1-3 (SEQ ID NO: 173 of U.S. Pat. No. 8,734,809), AAV CLv1-4 (SEQ ID NO: 174 of U.S. Pat. No. 8,734,809), AAV Clv1-7 (SEQ ID NO: 175 of U.S. Pat. No. 8,734,809), AAV Clv1-8 (SEQ ID NO: 176 of U.S. Pat. No. 8,734,809), AAV Clv1-9 (SEQ ID NO: 177 of U.S. Pat. No. 8,734,809), AAV Clv1-10 (SEQ ID NO: 178 of U.S. Pat. No. 8,734,809), AAV.VR-355 (SEQ ID NO: 181 of U.S. Pat. No. 8,734,809), AAV.hu.48R3 (SEQ ID NO: 183 of U.S. Pat. No. 8,734,809), or variants or derivatives thereof.

In some embodiments, the AAV serotype may be, or have, a sequence as described in International Publication No. WO2016065001, the contents of which are herein incorporated by reference in their entirety, such as, but not limited to AAV CHt-P2 (SEQ ID NO: 1 and 51 of WO2016065001), AAV CHt-P5 (SEQ ID NO: 2 and 52 of WO2016065001), AAV CHt-P9 (SEQ ID NO: 3 and 53 of WO2016065001), AAV CBr-7.1 (SEQ ID NO: 4 and 54 of WO2016065001), AAV CBr-7.2 (SEQ ID NO: 5 and 55 of WO2016065001), AAV CBr-7.3 (SEQ ID NO: 6 and 56 of WO2016065001), AAV CBr-7.4 (SEQ ID NO: 7 and 57 of WO2016065001), AAV CBr-7.5 (SEQ ID NO: 8 and 58 of WO2016065001), AAV CBr-7.7 (SEQ ID NO: 9 and 59 of WO2016065001), AAV CBr-7.8 (SEQ ID NO: 10 and 60 of WO2016065001), AAV CBr-7.10 (SEQ ID NO: 11 and 61 of WO2016065001), AAV CKd-N3 (SEQ ID NO: 12 and 62 of WO2016065001), AAV CKd-N4 (SEQ ID NO: 13 and 63 of WO2016065001), AAV CKd-N9 (SEQ ID NO: 14 and 64 of WO2016065001), AAV CLv-L4 (SEQ ID NO: 15 and 65 of WO2016065001), AAV CLv-L5 (SEQ ID NO: 16 and 66 of WO2016065001), AAV CLv-L6 (SEQ ID NO: 17 and 67 of WO2016065001), AAV CLv-K1 (SEQ ID NO: 18 and 68 of WO2016065001), AAV CLv-K3 (SEQ ID NO: 19 and 69 of WO2016065001), AAV CLv-K6 (SEQ ID NO: 20 and 70 of WO2016065001), AAV CLv-M1 (SEQ ID NO: 21 and 71 of WO02016065001), AAV CLv-M11 (SEQ ID NO: 22 and 72 of WO2016065001), AAV CLv-M2 (SEQ ID NO: 23 and 73 of WO2016065001), AAV CLv-M5 (SEQ ID NO: 24 and 74 of WO2016065001), AAV CLv-M6 (SEQ ID NO: 25 and 75 of WO2016065001), AAV CLv-M7 (SEQ ID NO: 26 and 76 of WO2016065001), AAV CLv-M8 (SEQ ID NO: 27 and 77 of WO2016065001), AAV CLv-M9 (SEQ ID NO: 28 and 78 of WO2016065001), AAV CHt-P1 (SEQ ID NO: 29 and 79 of WO2016065001), AAV CHt-P6 (SEQ ID NO: 30 and 80 of WO2016065001), AAV CHt-P8 (SEQ ID NO: 31 and 81 of WO2016065001), AAV CHt-6.1 (SEQ ID NO: 32 and 82 of WO2016065001), AAV CHt-6.10 (SEQ ID NO: 33 and 83 of WO2016065001), AAV CHt-6.5 (SEQ ID NO: 34 and 84 of WO2016065001), AAV CHt-6.6 (SEQ ID NO: 35 and 85 of WO2016065001), AAV CHt-6.7 (SEQ ID NO: 36 and 86 of WO2016065001), AAV CHt-6.8 (SEQ ID NO: 37 and 87 of WO2016065001), AAV CSp-8.10 (SEQ ID NO: 38 and 88 of WO2016065001), AAV CSp-8.2 (SEQ ID NO: 39 and 89 of WO02016065001), AAV CSp-8.4 (SEQ ID NO: 40 and 90 of WO2016065001), AAV CSp-8.5 (SEQ ID NO: 41 and 91 of WO2016065001), AAV CSp-8.6 (SEQ ID NO: 42 and 92 of WO2016065001), AAV CSp-8.7 (SEQ ID NO: 43 and 93 of WO2016065001), AAV CSp-8.8 (SEQ ID NO: 44 and 94 of WO2016065001), AAV CSp-8.9 (SEQ ID NO: 45 and 95 of WO2016065001), AAV CBr-B7.3 (SEQ ID NO: 46 and 96 of WO2016065001), AAV CBr-B7.4 (SEQ ID NO: 47 and 97 of WO2016065001), AAV3B (SEQ ID NO: 48 and 98 of WO2016065001), AAV4 (SEQ ID NO: 49 and 99 of WO2016065001), AAV5 (SEQ ID NO: 50 and 100 of WO2016065001), or variants or derivatives thereof.

In one embodiment, the AAV may be a serotype selected from any of those found in Table 1.

In one embodiment, the AAV may comprise a sequence, fragment or variant thereof, of the sequences in Table 1.

In one embodiment, the AAV may be encoded by a sequence, fragment or variant as described in Table 1.

TABLE 1

AAV Serotypes

| Serotype | SEQ ID NO | Reference Information |
|---|---|---|
| AAV1 | 1 | US20150159173 SEQ ID NO: 11, US20150315612 SEQ ID NO: 202 |
| AAV1 | 2 | US20160017295 SEQ ID NO: 1, US20030138772 SEQ ID NO: 64, US20150159173 SEQ ID NO: 27, US20150315612 SEQ ID NO: 219, U.S. Pat. No. 7,198,951 SEQ ID NO: 5 |
| AAV1 | 3 | US20030138772 SEQ ID NO: 6 |
| AAV1.3 | 4 | US20030138772 SEQ ID NO: 14 |
| AAV10 | 5 | US20030138772 SEQ ID NO: 117 |
| AAV10 | 6 | WO2015121501 SEQ ID NO: 9 |
| AAV10 | 7 | WO2015121501 SEQ ID NO: 8 |
| AAV11 | 8 | US20030138772 SEQ ID NO: 118 |
| AAV12 | 9 | US20030138772 SEQ ID NO: 119 |
| AAV2 | 10 | US20150159173 SEQ ID NO: 7, US20150315612 SEQ ID NO: 211 |
| AAV2 | 11 | US20030138772 SEQ ID NO: 70, US20150159173 SEQ ID NO: 23, US20150315612 SEQ ID NO: 221, US20160017295 SEQ ID NO: 2, U.S. Pat. No. 6,156,303 SEQ ID NO: 4, U.S. Pat. No. 7,198,951 SEQ ID NO: 4, WO2015121501 SEQ ID NO: 1 |
| AAV2 | 12 | U.S. Pat. No. 6,156,303 SEQ ID NO: 8 |
| AAV2 | 13 | US20030138772 SEQ ID NO: 7 |
| AAV2 | 14 | U.S. Pat. No. 6,156,303 SEQ ID NO: 3 |
| AAV2.5T | 15 | U.S. Pat. No. 9,233,131 SEQ ID NO: 42 |
| AAV223.10 | 16 | US20030138772 SEQ ID NO: 75 |
| AAV223.2 | 17 | US20030138772 SEQ ID NO: 49 |

TABLE 1-continued

AAV Serotypes

| Serotype | SEQ ID NO | Reference Information |
|---|---|---|
| AAV223.2 | 18 | US20030138772 SEQ ID NO: 76 |
| AAV223.4 | 19 | US20030138772 SEQ ID NO: 50 |
| AAV223.4 | 20 | US20030138772 SEQ ID NO: 73 |
| AAV223.5 | 21 | US20030138772 SEQ ID NO: 51 |
| AAV223.5 | 22 | US20030138772 SEQ ID NO: 74 |
| AAV223.6 | 23 | US20030138772 SEQ ID NO: 52 |
| AAV223.6 | 24 | US20030138772 SEQ ID NO: 78 |
| AAV223.7 | 25 | US20030138772 SEQ ID NO: 53 |
| AAV223.7 | 26 | US20030138772 SEQ ID NO: 77 |
| AAV29.3 | 27 | US20030138772 SEQ ID NO: 82 |
| AAV29.4 | 28 | US20030138772 SEQ ID NO: 12 |
| AAV29.5 | 29 | US20030138772 SEQ ID NO: 83 |
| AAV29.5 (AAVbb.2) | 30 | US20030138772 SEQ ID NO: 13 |
| AAV3 | 31 | US20150159173 SEQ ID NO: 12 |
| AAV3 | 32 | US20030138772 SEQ ID NO: 71, US20150159173 SEQ ID NO: 28, US20160017295 SEQ ID NO: 3, U.S. Pat. No. 7,198,951 SEQ ID NO: 6 |
| AAV3 | 33 | US20030138772 SEQ ID NO: 8 |
| AAV3.3b | 34 | US20030138772 SEQ ID NO: 72 |
| AAV3-3 | 35 | US20150315612 SEQ ID NO: 200 |
| AAV3-3 | 36 | US20150315612 SEQ ID NO: 217 |
| AAV3a | 37 | U.S. Pat. No. 6,156,303 SEQ ID NO: 5 |
| AAV3a | 38 | U.S. Pat. No. 6,156,303 SEQ ID NO: 9 |
| AAV3b | 39 | U.S. Pat. No. 6,156,303 SEQ ID NO: 6 |
| AAV3b | 40 | U.S. Pat. No. 6,156,303 SEQ ID NO: 10 |
| AAV3b | 41 | U.S. Pat. No. 6,156,303 SEQ ID NO: 1 |
| AAV4 | 42 | US20140348794 SEQ ID NO: 17 |
| AAV4 | 43 | US20140348794 SEQ ID NO: 5 |
| AAV4 | 44 | US20140348794 SEQ ID NO: 3 |
| AAV4 | 45 | US20140348794 SEQ ID NO: 14 |
| AAV4 | 46 | US20140348794 SEQ ID NO: 15 |
| AAV4 | 47 | US20140348794 SEQ ID NO: 19 |
| AAV4 | 48 | US20140348794 SEQ ID NO: 12 |
| AAV4 | 49 | US20140348794 SEQ ID NO: 13 |
| AAV4 | 50 | US20140348794 SEQ ID NO: 7 |
| AAV4 | 51 | US20140348794 SEQ ID NO: 8 |
| AAV4 | 52 | US20140348794 SEQ ID NO: 9 |
| AAV4 | 53 | US20140348794 SEQ ID NO: 2 |
| AAV4 | 54 | US20140348794 SEQ ID NO: 10 |
| AAV4 | 55 | US20140348794 SEQ ID NO: 11 |
| AAV4 | 56 | US20140348794 SEQ ID NO: 18 |
| AAV4 | 57 | US20030138772 SEQ ID NO: 63, US20160017295 SEQ ID NO: 4, US20140348794 SEQ ID NO: 4 |
| AAV4 | 58 | US20140348794 SEQ ID NO: 16 |
| AAV4 | 59 | US20140348794 SEQ ID NO: 20 |
| AAV4 | 60 | US20140348794 SEQ ID NO: 6 |
| AAV4 | 61 | US20140348794 SEQ ID NO: 1 |
| AAV42.2 | 62 | US20030138772 SEQ ID NO: 9 |
| AAV42.2 | 63 | US20030138772 SEQ ID NO: 102 |
| AAV42.3b | 64 | US20030138772 SEQ ID NO: 36 |
| AAV42.3B | 65 | US20030138772 SEQ ID NO: 107 |
| AAV42.4 | 66 | US20030138772 SEQ ID NO: 33 |
| AAV42.4 | 67 | US20030138772 SEQ ID NO: 88 |
| AAV42.8 | 68 | US20030138772 SEQ ID NO: 27 |
| AAV42.8 | 69 | US20030138772 SEQ ID NO: 85 |
| AAV43.1 | 70 | US20030138772 SEQ ID NO: 39 |
| AAV43.1 | 71 | US20030138772 SEQ ID NO: 92 |
| AAV43.12 | 72 | US20030138772 SEQ ID NO: 41 |
| AAV43.12 | 73 | US20030138772 SEQ ID NO: 93 |
| AAV43.20 | 74 | US20030138772 SEQ ID NO: 42 |
| AAV43.20 | 75 | US20030138772 SEQ ID NO: 99 |
| AAV43.21 | 76 | US20030138772 SEQ ID NO: 43 |
| AAV43.21 | 77 | US20030138772 SEQ ID NO: 96 |
| AAV43.23 | 78 | US20030138772 SEQ ID NO: 44 |
| AAV43.23 | 79 | US20030138772 SEQ ID NO: 98 |
| AAV43.25 | 80 | US20030138772 SEQ ID NO: 45 |
| AAV43.25 | 81 | US20030138772 SEQ ID NO: 97 |
| AAV43.5 | 82 | US20030138772 SEQ ID NO: 40 |
| AAV43.5 | 83 | US20030138772 SEQ ID NO: 94 |
| AAV4-4 | 84 | US20150315612 SEQ ID NO: 201 |
| AAV4-4 | 85 | US20150315612 SEQ ID NO: 218 |

TABLE 1-continued

AAV Serotypes

| Serotype | SEQ ID NO | Reference Information |
|---|---|---|
| AAV44.1 | 86 | US20030138772 SEQ ID NO: 46 |
| AAV44.1 | 87 | US20030138772 SEQ ID NO: 79 |
| AAV44.5 | 88 | US20030138772 SEQ ID NO: 47 |
| AAV44.5 | 89 | US20030138772 SEQ ID NO: 80 |
| AAV4407 | 90 | US20150315612 SEQ ID NO: 90 |
| AAV5 | 91 | U.S. Pat. No. 7,427,396 SEQ ID NO: 1 |
| AAV5 | 92 | US20030138772 SEQ ID NO: 114 |
| AAV5 | 93 | US20160017295 SEQ ID NO: 5, U.S. Pat. No. 7,427,396 SEQ ID NO: 2, US20150315612 SEQ ID NO: 216 |
| AAV5 | 94 | US20150315612 SEQ ID NO: 199 |
| AAV6 | 95 | US20150159173 SEQ ID NO: 13 |
| AAV6 | 96 | US20030138772 SEQ ID NO: 65, US20150159173 SEQ ID NO: 29, US20160017295 SEQ ID NO: 6, U.S. Pat. No. 6,156,303 SEQ ID NO: 7 |
| AAV6 | 97 | U.S. Pat. No. 6,156,303 SEQ ID NO: 11 |
| AAV6 | 98 | U.S. Pat. No. 6,156,303 SEQ ID NO: 2 |
| AAV6 | 99 | US20150315612 SEQ ID NO: 203 |
| AAV6 | 100 | US20150315612 SEQ ID NO: 220 |
| AAV6.1 | 101 | US20150159173 |
| AAV6.12 | 102 | US20150159173 |
| AAV6.2 | 103 | US20150159173 |
| AAV7 | 104 | US20150159173 SEQ ID NO: 14 |
| AAV7 | 105 | US20150315612 SEQ ID NO: 183 |
| AAV7 | 106 | US20030138772 SEQ ID NO: 2, US20150159173 SEQ ID NO: 30, US20150315612 SEQ ID NO: 181, US20160017295 SEQ ID NO: 7 |
| AAV7 | 107 | US20030138772 SEQ ID NO: 3 |
| AAV7 | 108 | US20030138772 SEQ ID NO: 1, US20150315612 SEQ ID NO: 180 |
| AAV7 | 109 | US20150315612 SEQ ID NO: 213 |
| AAV7 | 110 | US20150315612 SEQ ID NO: 222 |
| AAV8 | 111 | US20150159173 SEQ ID NO: 15 |
| AAV8 | 112 | US20150376240 SEQ ID NO: 7 |
| AAV8 | 113 | US20030138772 SEQ ID NO: 4, US20150315612 SEQ ID NO: 182 |
| AAV8 | 114 | US20030138772 SEQ ID NO: 95, US20140359799 SEQ ID NO: 1, US20150159173 SEQ ID NO: 31, US20160017295 SEQ ID NO: 8, U.S. Pat. No. 7,198,951 SEQ ID NO: 7, US20150315612 SEQ ID NO: 223 |
| AAV8 | 115 | US20150376240 SEQ ID NO: 8 |
| AAV8 | 116 | US20150315612 SEQ ID NO: 214 |
| AAV-8b | 117 | US20150376240 SEQ ID NO: 5 |
| AAV-8b | 118 | US20150376240 SEQ ID NO: 3 |
| AAV-8h | 119 | US20150376240 SEQ ID NO: 6 |
| AAV-8h | 120 | US20150376240 SEQ ID NO: 4 |
| AAV9 | 121 | US20030138772 SEQ ID NO: 5 |
| AAV9 | 122 | U.S. Pat. No. 7,198,951 SEQ ID NO: 1 |
| AAV9 | 123 | US20160017295 SEQ ID NO: 9 |
| AAV9 | 124 | US20030138772 SEQ ID NO: 100, U.S. Pat. No. 7,198,951 SEQ ID NO: 2 |
| AAV9 | 125 | U.S. Pat. No. 7,198,951 SEQ ID NO: 3 |
| AAV9 (AAVhu.14) | 126 | U.S. Pat. No. 7,906,111 SEQ ID NO: 3; WO2015038958 SEQ ID NO: 11 |
| AAV9 (AAVhu.14) | 127 | U.S. Pat. No. 7,906,111 SEQ ID NO: 123; WO2015038958 SEQ ID NO: 2 |
| AAVA3.1 | 128 | US20030138772 SEQ ID NO: 120 |
| AAVA3.3 | 129 | US20030138772 SEQ ID NO: 57 |
| AAVA3.3 | 130 | US20030138772 SEQ ID NO: 66 |
| AAVA3.4 | 131 | US20030138772 SEQ ID NO: 54 |
| AAVA3.4 | 132 | US20030138772 SEQ ID NO: 68 |
| AAVA3.5 | 133 | US20030138772 SEQ ID NO: 55 |
| AAVA3.5 | 134 | US20030138772 SEQ ID NO: 69 |
| AAVA3.7 | 135 | US20030138772 SEQ ID NO: 56 |
| AAVA3.7 | 136 | US20030138772 SEQ ID NO: 67 |
| AAV29.3 (AAVbb.1) | 137 | US20030138772 SEQ ID NO: 11 |
| AAVC2 | 138 | US20030138772 SEQ ID NO: 61 |
| AAV Ch.5 | 139 | US20150159173 SEQ ID NO: 46, US20150315612 SEQ ID NO: 234 |
| AAVcy.2 (AAV13.3) | 140 | US20030138772 SEQ ID NO: 15 |
| AAV24.1 | 141 | US20030138772 SEQ ID NO: 101 |
| AAVcy.3 (AAV24.1) | 142 | US20030138772 SEQ ID NO: 16 |
| AAV27.3 | 143 | US20030138772 SEQ ID NO: 104 |
| AAVcy.4 (AAV27.3) | 144 | US20030138772 SEQ ID NO: 17 |
| AAVcy.5 | 145 | US20150315612 SEQ ID NO: 227 |
| AAV7.2 | 146 | US20030138772 SEQ ID NO: 103 |
| AAVcy.5 (AAV7.2) | 147 | US20030138772 SEQ ID NO: 18 |
| AAV16.3 | 148 | US20030138772 SEQ ID NO: 105 |
| AAVcy.6 (AAV16.3) | 149 | US20030138772 SEQ ID NO: 10 |
| AAVcy.5 | 150 | US20150159173 SEQ ID NO: 8 |
| AAVcy.5 | 151 | US20150159173 SEQ ID NO: 24 |
| AAVCy.5R1 | 152 | US20150159173 |
| AAVCy.5R2 | 153 | US20150159173 |
| AAVCy.5R3 | 154 | US20150159173 |
| AAVCy.5R4 | 155 | US20150159173 |
| AAVDJ | 156 | US20140359799 SEQ ID NO: 3, U.S. Pat. No. 7,588,772 SEQ ID NO: 2 |
| AAVDJ | 157 | US20140359799 SEQ ID NO: 2, U.S. Pat. No. 7,588,772 SEQ ID NO: 1 |
| AAVDJ-8 | 158 | U.S. Pat. No. 7,588,772; Grimm et al 2008 |
| AAVDJ-8 | 159 | U.S. Pat. No. 7,588,772; Grimm et al 2008 |
| AAVF5 | 160 | US20030138772 SEQ ID NO: 110 |
| AAVH2 | 161 | US20030138772 SEQ ID NO: 26 |
| AAVH6 | 162 | US20030138772 SEQ ID NO: 25 |
| AAVhE1.1 | 163 | U.S. Pat. No. 9,233,131 SEQ ID NO: 44 |
| AAVhEr1.14 | 164 | U.S. Pat. No. 9,233,131 SEQ ID NO: 46 |
| AAVhEr1.16 | 165 | U.S. Pat. No. 9,233,131 SEQ ID NO: 48 |
| AAVhEr1.18 | 166 | U.S. Pat. No. 9,233,131 SEQ ID NO: 49 |
| AAVhEr1.23 (AAVhEr2.29) | 167 | U.S. Pat. No. 9,233,131 SEQ ID NO: 53 |
| AAVhEr1.35 | 168 | U.S. Pat. No. 9,233,131 SEQ ID NO: 50 |
| AAVhEr1.36 | 169 | U.S. Pat. No. 9,233,131 SEQ ID NO: 52 |
| AAVhEr1.5 | 170 | U.S. Pat. No. 9,233,131 SEQ ID NO: 45 |
| AAVhEr1.7 | 171 | U.S. Pat. No. 9,233,131 SEQ ID NO: 51 |
| AAVhEr1.8 | 172 | U.S. Pat. No. 9,233,131 SEQ ID NO: 47 |
| AAVhEr2.16 | 173 | U.S. Pat. No. 9,233,131 SEQ ID NO: 55 |
| AAVhEr2.30 | 174 | U.S. Pat. No. 9,233,131 SEQ ID NO: 56 |
| AAVhEr2.31 | 175 | U.S. Pat. No. 9,233,131 SEQ ID NO: 58 |
| AAVhEr2.36 | 176 | U.S. Pat. No. 9,233,131 SEQ ID NO: 57 |
| AAVhEr2.4 | 177 | U.S. Pat. No. 9,233,131 SEQ ID NO: 54 |
| AAVhEr3.1 | 178 | U.S. Pat. No. 9,233,131 SEQ ID NO: 59 |
| AAVhu.1 | 179 | US20150315612 SEQ ID NO: 46 |
| AAVhu.1 | 180 | US20150315612 SEQ ID NO: 144 |
| AAVhu.10 (AAV16.8) | 181 | US20150315612 SEQ ID NO: 56 |
| AAVhu.10 (AAV16.8) | 182 | US20150315612 SEQ ID NO: 156 |
| AAVhu.11 (AAV16.12) | 183 | US20150315612 SEQ ID NO: 57 |
| AAVhu.11 (AAV16.12) | 184 | US20150315612 SEQ ID NO: 153 |
| AAVhu.12 | 185 | US20150315612 SEQ ID NO: 59 |
| AAVhu.12 | 186 | US20150315612 SEQ ID NO: 154 |
| AAVhu.13 | 187 | US20150159173 SEQ ID NO: 16, US20150315612 SEQ ID NO: 71 |
| AAVhu.13 | 188 | US20150159173 SEQ ID NO: 32, US20150315612 SEQ ID NO: 129 |
| AAVhu.136.1 | 189 | US20150315612 SEQ ID NO: 165 |
| AAVhu.140.1 | 190 | US20150315612 SEQ ID NO: 166 |
| AAVhu.140.2 | 191 | US20150315612 SEQ ID NO: 167 |
| AAVhu.145.6 | 192 | US20150315612 SEQ ID No: 178 |
| AAVhu.15 | 193 | US20150315612 SEQ ID NO: 147 |
| AAVhu.15 (AAV33.4) | 194 | US20150315612 SEQ ID NO: 50 |
| AAVhu.156.1 | 195 | US20150315612 SEQ ID No: 179 |
| AAVhu.16 | 196 | US20150315612 SEQ ID NO: 148 |

TABLE 1-continued

AAV Serotypes

| Serotype | SEQ ID NO | Reference Information |
|---|---|---|
| AAVhu.16 (AAV33.8) | 197 | US20150315612 SEQ ID NO: 51 |
| AAVhu.17 | 198 | US20150315612 SEQ ID NO: 83 |
| AAVhu.17 (AAV33.12) | 199 | US20150315612 SEQ ID NO: 4 |
| AAVhu.172.1 | 200 | US20150315612 SEQ ID NO: 171 |
| AAVhu.172.2 | 201 | US20150315612 SEQ ID NO: 172 |
| AAVhu.173.4 | 202 | US20150315612 SEQ ID NO: 173 |
| AAVhu.173.8 | 203 | US20150315612 SEQ ID NO: 175 |
| AAVhu.18 | 204 | US20150315612 SEQ ID NO: 52 |
| AAVhu.18 | 205 | US20150315612 SEQ ID NO: 149 |
| AAVhu.19 | 206 | US20150315612 SEQ ID NO: 62 |
| AAVhu.19 | 207 | US20150315612 SEQ ID NO: 133 |
| AAVhu.2 | 208 | US20150315612 SEQ ID NO: 48 |
| AAVhu.2 | 209 | US20150315612 SEQ ID NO: 143 |
| AAVhu.20 | 210 | US20150315612 SEQ ID NO: 63 |
| AAVhu.20 | 211 | US20150315612 SEQ ID NO: 134 |
| AAVhu.21 | 212 | US20150315612 SEQ ID NO: 65 |
| AAVhu.21 | 213 | US20150315612 SEQ ID NO: 135 |
| AAVhu.22 | 214 | US20150315612 SEQ ID NO: 67 |
| AAVhu.22 | 215 | US20150315612 SEQ ID NO: 138 |
| AAVhu.23 | 216 | US20150315612 SEQ ID NO: 60 |
| AAVhu.23.2 | 217 | US20150315612 SEQ ID NO: 137 |
| AAVhu.24 | 218 | US20150315612 SEQ ID NO: 66 |
| AAVhu.24 | 219 | US20150315612 SEQ ID NO: 136 |
| AAVhu.25 | 220 | US20150315612 SEQ ID NO: 49 |
| AAVhu.25 | 221 | US20150315612 SEQ ID NO: 146 |
| AAVhu.26 | 222 | US20150159173 SEQ ID NO: 17, US20150315612 SEQ ID NO: 61 |
| AAVhu.26 | 223 | US20150159173 SEQ ID NO: 33, US20150315612 SEQ ID NO: 139 |
| AAVhu.27 | 224 | US20150315612 SEQ ID NO: 64 |
| AAVhu.27 | 225 | US20150315612 SEQ ID NO: 140 |
| AAVhu.28 | 226 | US20150315612 SEQ ID NO: 68 |
| AAVhu.28 | 227 | US20150315612 SEQ ID NO: 130 |
| AAVhu.29 | 228 | US20150315612 SEQ ID NO: 69 |
| AAVhu.29 | 229 | US20150159173 SEQ ID NO: 42, US20150315612 SEQ ID NO: 132 |
| AAVhu.29 | 230 | US20150315612 SEQ ID NO: 225 |
| AAVhu.29R | 231 | US20150159173 |
| AAVhu.3 | 232 | US20150315612 SEQ ID NO: 44 |
| AAVhu.3 | 233 | US20150315612 SEQ ID NO: 145 |
| AAVhu.30 | 234 | US20150315612 SEQ ID NO: 70 |
| AAVhu.30 | 235 | US20150315612 SEQ ID NO: 131 |
| AAVhu.31 | 236 | US20150315612 SEQ ID NO: 1 |
| AAVhu.31 | 237 | US20150315612 SEQ ID NO: 121 |
| AAVhu.32 | 238 | US20150315612 SEQ ID NO: 2 |
| AAVhu.32 | 239 | US20150315612 SEQ ID NO: 122 |
| AAVhu.33 | 240 | US20150315612 SEQ ID NO: 75 |
| AAVhu.33 | 241 | US20150315612 SEQ ID NO: 124 |
| AAVhu.34 | 242 | US20150315612 SEQ ID NO: 72 |
| AAVhu.34 | 243 | US20150315612 SEQ ID NO: 125 |
| AAVhu.35 | 244 | US20150315612 SEQ ID NO: 73 |
| AAVhu.35 | 245 | US20150315612 SEQ ID NO: 164 |
| AAVhu.36 | 246 | US20150315612 SEQ ID NO: 74 |
| AAVhu.36 | 247 | US20150315612 SEQ ID NO: 126 |
| AAVhu.37 | 248 | US20150159173 SEQ ID NO: 34, US20150315612 SEQ ID NO: 88 |
| AAVhu.37 (AAV106.1) | 249 | US20150315612 SEQ ID NO: 10, US20150159173 SEQ ID NO: 18 |
| AAVhu.38 | 250 | US20150315612 SEQ ID NO: 161 |
| AAVhu.39 | 251 | US20150315612 SEQ ID NO: 102 |
| AAVhu.39 (AAVLG-9) | 252 | US20150315612 SEQ ID NO: 24 |
| AAVhu.4 | 253 | US20150315612 SEQ ID NO: 47 |
| AAVhu.4 | 254 | US20150315612 SEQ ID NO: 141 |
| AAVhu.40 | 255 | US20150315612 SEQ ID NO: 87 |
| AAVhu.40 (AAV114.3) | 256 | US20150315612 SEQ ID No: 11 |
| AAVhu.41 | 257 | US20150315612 SEQ ID NO: 91 |
| AAVhu.41 (AAV127.2) | 258 | US20150315612 SEQ ID NO: 6 |
| AAVhu.42 | 259 | US20150315612 SEQ ID NO: 85 |
| AAVhu.42 (AAV127.5) | 260 | US20150315612 SEQ ID NO: 8 |
| AAVhu.43 | 261 | US20150315612 SEQ ID NO: 160 |
| AAVhu.43 | 262 | US20150315612 SEQ ID NO: 236 |
| AAVhu.43 (AAV128.1) | 263 | US20150315612 SEQ ID NO: 80 |
| AAVhu.44 | 264 | US20150159173 SEQ ID NO: 45, US20150315612 SEQ ID NO: 158 |
| AAVhu.44 AAV1283 | 265 | US20150315612 SEQ ID NO: 81 |
| AAVhu.44R1 | 266 | US20150159173 |
| AAVhu.44R2 | 267 | US20150159173 |
| AAVhu.44R3 | 268 | US20150159173 |
| AAVhu.45 | 269 | US20150315612 SEQ ID NO: 76 |
| AAVhu.45 | 270 | US20150315612 SEQ ID NO: 127 |
| AAVhu.46 | 271 | US20150315612 SEQ ID NO: 82 |
| AAVhu.46 | 272 | US20150315612 SEQ ID NO: 159 |
| AAVhu.46 | 273 | US20150315612 SEQ ID NO: 224 |
| AAVhu.47 | 274 | US20150315612 SEQ ID NO: 77 |
| AAVhu.47 | 275 | US20150315612 SEQ ID NO: 128 |
| AAVhu.48 | 276 | US20150159173 SEQ ID NO: 38 |
| AAVhu.48 | 277 | US20150315612 SEQ ID NO: 157 |
| AAVhu.48 (AAV130.4) | 278 | US20150315612 SEQ ID NO: 78 |
| AAVhu.48R1 | 279 | US20150159173 |
| AAVhu.48R2 | 280 | US20150159173 |
| AAVhu.48R3 | 281 | US20150159173 |
| AAVhu.49 | 282 | US20150315612 SEQ ID NO: 209 |
| AAVhu.49 | 283 | US20150315612 SEQ ID NO: 189 |
| AAVhu.5 | 284 | US20150315612 SEQ ID NO: 45 |
| AAVhu.5 | 285 | US20150315612 SEQ ID NO: 142 |
| AAVhu.51 | 286 | US20150315612 SEQ ID NO: 208 |
| AAVhu.51 | 287 | US20150315612 SEQ ID NO: 190 |
| AAVhu.52 | 288 | US20150315612 SEQ ID NO: 210 |
| AAVhu.52 | 289 | US20150315612 SEQ ID NO: 191 |
| AAVhu.53 | 290 | US20150159173 SEQ ID NO: 19 |
| AAVhu.53 | 291 | US20150159173 SEQ ID NO: 35 |
| AAVhu.53 (AAV145.1) | 292 | US20150315612 SEQ ID NO: 176 |
| AAVhu.54 | 293 | US20150315612 SEQ ID NO: 188 |
| AAVhu.54 (AAV145.5) | 294 | US20150315612 SEQ ID No: 177 |
| AAVhu.55 | 295 | US20150315612 SEQ ID NO: 187 |
| AAVhu.56 | 296 | US20150315612 SEQ ID NO: 205 |
| AAVhu.56 (AAV145.6) | 297 | US20150315612 SEQ ID NO: 168 |
| AAVhu.56 (AAV145.6) | 298 | US20150315612 SEQ ID NO: 192 |
| AAVhu.57 | 299 | US20150315612 SEQ ID NO: 206 |
| AAVhu.57 | 300 | US20150315612 SEQ ID NO: 169 |
| AAVhu.57 | 301 | US20150315612 SEQ ID NO: 193 |
| AAVhu.58 | 302 | US20150315612 SEQ ID NO: 207 |
| AAVhu.58 | 303 | US20150315612 SEQ ID NO: 194 |
| AAVhu.6 (AAV3.1) | 304 | US20150315612 SEQ ID NO: 5 |
| AAVhu.6 (AAV3.1) | 305 | US20150315612 SEQ ID NO: 84 |
| AAVhu.60 | 306 | US20150315612 SEQ ID NO: 184 |
| AAVhu.60 (AAV161.10) | 307 | US20150315612 SEQ ID NO: 170 |
| AAVhu.61 | 308 | US20150315612 SEQ ID NO: 185 |
| AAVhu.61 (AAV161.6) | 309 | US20150315612 SEQ ID NO: 174 |
| AAVhu.63 | 310 | US20150315612 SEQ ID NO: 204 |
| AAVhu.63 | 311 | US20150315612 SEQ ID NO: 195 |
| AAVhu.64 | 312 | US20150315612 SEQ ID NO: 212 |
| AAVhu.64 | 313 | US20150315612 SEQ ID NO: 196 |
| AAVhu.66 | 314 | US20150315612 SEQ ID NO: 197 |
| AAVhu.67 | 315 | US20150315612 SEQ ID NO: 215 |
| AAVhu.67 | 316 | US20150315612 SEQ ID NO: 198 |
| AAVhu.7 | 317 | US20150315612 SEQ ID NO: 226 |
| AAVhu.7 | 318 | US20150315612 SEQ ID NO: 150 |
| AAVhu.7 (AAV7.3) | 319 | US20150315612 SEQ ID NO: 55 |

TABLE 1-continued

AAV Serotypes

| Serotype | SEQ ID NO | Reference Information |
|---|---|---|
| AAVhu.71 | 320 | US20150315612 SEQ ID NO: 79 |
| AAVhu.8 | 321 | US20150315612 SEQ ID NO: 53 |
| AAVhu.8 | 322 | US20150315612 SEQ ID NO: 12 |
| AAVhu.8 | 323 | US20150315612 SEQ ID NO: 151 |
| AAVhu.9 (AAV3.1) | 324 | US20150315612 SEQ ID NO: 58 |
| AAVhu.9 (AAV3.1) | 325 | US20150315612 SEQ ID NO: 155 |
| AAV-LK01 | 326 | US20150376607 SEQ ID NO: 2 |
| AAV-LK01 | 327 | US20150376607 SEQ ID NO: 29 |
| AAV-LK02 | 328 | US20150376607 SEQ ID NO: 3 |
| AAV-LK02 | 329 | US20150376607 SEQ ID NO: 30 |
| AAV-LK03 | 330 | US20150376607 SEQ ID NO: 4 |
| AAV-LK03 | 331 | WO2015121501 SEQ ID NO: 12, US20150376607 SEQ ID NO: 31 |
| AAV-LK04 | 332 | US20150376607 SEQ ID NO: 5 |
| AAV-LK04 | 333 | US20150376607 SEQ ID NO: 32 |
| AAV-LK05 | 334 | US20150376607 SEQ ID NO: 6 |
| AAV-LK05 | 335 | US20150376607 SEQ ID NO: 33 |
| AAV-LK06 | 336 | US20150376607 SEQ ID NO: 7 |
| AAV-LK06 | 337 | US20150376607 SEQ ID NO: 34 |
| AAV-LK07 | 338 | US20150376607 SEQ ID NO: 8 |
| AAV-LK07 | 339 | US20150376607 SEQ ID NO: 35 |
| AAV-LK08 | 340 | US20150376607 SEQ ID NO: 9 |
| AAV-LK08 | 341 | US20150376607 SEQ ID NO: 36 |
| AAV-LK09 | 342 | US20150376607 SEQ ID NO: 10 |
| AAV-LK09 | 343 | US20150376607 SEQ ID NO: 37 |
| AAV-LK10 | 344 | US20150376607 SEQ ID NO: 11 |
| AAV-LK10 | 345 | US20150376607 SEQ ID NO: 38 |
| AAV-LK11 | 346 | US20150376607 SEQ ID NO: 12 |
| AAV-LK11 | 347 | US20150376607 SEQ ID NO: 39 |
| AAV-LK12 | 348 | US20150376607 SEQ ID NO: 13 |
| AAV-LK12 | 349 | US20150376607 SEQ ID NO: 40 |
| AAV-LK13 | 350 | US20150376607 SEQ ID NO: 14 |
| AAV-LK13 | 351 | US20150376607 SEQ ID NO: 41 |
| AAV-LK14 | 352 | US20150376607 SEQ ID NO: 15 |
| AAV-LK14 | 353 | US20150376607 SEQ ID NO: 42 |
| AAV-LK15 | 354 | US20150376607 SEQ ID NO: 16 |
| AAV-LK15 | 355 | US20150376607 SEQ ID NO: 43 |
| AAV-LK16 | 356 | US20150376607 SEQ ID NO: 17 |
| AAV-LK16 | 357 | US20150376607 SEQ ID NO: 44 |
| AAV-LK17 | 358 | US20150376607 SEQ ID NO: 18 |
| AAV-LK17 | 359 | US20150376607 SEQ ID NO: 45 |
| AAV-LK18 | 360 | US20150376607 SEQ ID NO: 19 |
| AAV-LK18 | 361 | US20150376607 SEQ ID NO: 46 |
| AAV-LK19 | 362 | US20150376607 SEQ ID NO: 20 |
| AAV-LK19 | 363 | US20150376607 SEQ ID NO: 47 |
| AAV-PAEC | 364 | US20150376607 SEQ ID NO: 1 |
| AAV-PAEC | 365 | US20150376607 SEQ ID NO: 48 |
| AAV-PAEC11 | 366 | US20150376607 SEQ ID NO: 26 |
| AAV-PAEC11 | 367 | US20150376607 SEQ ID NO: 54 |
| AAV-PAEC12 | 368 | US20150376607 SEQ ID NO: 27 |
| AAV-PAEC12 | 369 | US20150376607 SEQ ID NO: 51 |
| AAV-PAEC13 | 370 | US20150376607 SEQ ID NO: 28 |
| AAV-PAEC13 | 371 | US20150376607 SEQ ID NO: 49 |
| AAV-PAEC2 | 372 | US20150376607 SEQ ID NO: 21 |
| AAV-PAEC2 | 373 | US20150376607 SEQ ID NO: 56 |
| AAV-PAEC4 | 374 | US20150376607 SEQ ID NO: 22 |
| AAV-PAEC4 | 375 | US20150376607 SEQ ID NO: 55 |
| AAV-PAEC6 | 376 | US20150376607 SEQ ID NO: 23 |
| AAV-PAEC6 | 377 | US20150376607 SEQ ID NO: 52 |
| AAV-PAEC7 | 378 | US20150376607 SEQ ID NO: 24 |
| AAV-PAEC7 | 379 | US20150376607 SEQ ID NO: 53 |
| AAV-PAEC8 | 380 | US20150376607 SEQ ID NO: 25 |
| AAV-PAEC8 | 381 | US20150376607 SEQ ID NO: 50 |
| AAVpi.1 | 382 | US20150315612 SEQ ID NO: 28 |
| AAVpi.1 | 383 | US20150315612 SEQ ID NO: 93 |
| AAVpi.2 | 384 | US20150315612 SEQ ID NO: 30 |
| AAVpi.2 | 385 | US20150315612 SEQ ID NO: 95 |
| AAVpi.3 | 386 | US20150315612 SEQ ID NO: 29 |
| AAVpi.3 | 387 | US20150315612 SEQ ID NO: 94 |
| AAVrh.10 | 388 | US20150159173 SEQ ID NO: 9 |
| AAVrh.10 | 389 | US20150159173 SEQ ID NO: 25 |
| AAV44.2 | 390 | US20030138772 SEQ ID NO: 59 |
| AAVrh.10 (AAV44.2) | 391 | US20030138772 SEQ ID NO: 81 |
| AAV42.1B | 392 | US20030138772 SEQ ID NO: 90 |
| AAVrh.12 (AAV42.1b) | 393 | US20030138772 SEQ ID NO: 30 |
| AAVrh.13 | 394 | US20150159173 SEQ ID NO: 10 |
| AAVrh.13 | 395 | US20150159173 SEQ ID NO: 26 |
| AAVrh.13 | 396 | US20150315612 SEQ ID NO: 228 |
| AAVrh3.13R | 397 | US20150159173 |
| AAV42.3A | 398 | US20030138772 SEQ ID NO: 87 |
| AAVrh.14 (AAV42.3a) | 399 | US20030138772 SEQ ID NO: 32 |
| AAV42.5A | 400 | US20030138772 SEQ ID NO: 89 |
| AAVrh.17 (AAV42.5a) | 401 | US20030138772 SEQ ID NO: 34 |
| AAV42.5B | 402 | US20030138772 SEQ ID NO: 91 |
| AAVrh.18 (AAV42.5b) | 403 | US20030138772 SEQ ID NO: 29 |
| AAV42.6B | 404 | US20030138772 SEQ ID NO: 112 |
| AAVrh.19 (AAV42.6b) | 405 | US20030138772 SEQ ID NO: 38 |
| AAVrh.2 | 406 | US20150159173 SEQ ID NO: 39 |
| AAVrh.2 | 407 | US20150315612 SEQ ID NO: 231 |
| AAVrh.20 | 408 | US20150159173 SEQ ID NO: 1 |
| AAV42.10 | 409 | US20030138772 SEQ ID NO: 106 |
| AAVrh.21 (AAV42.10) | 410 | US20030138772 SEQ ID NO: 35 |
| AAV42.11 | 411 | US20030138772 SEQ ID NO: 108 |
| AAVrh.22 (AAV42.11) | 412 | US20030138772 SEQ ID NO: 37 |
| AAV42.12 | 413 | US20030138772 SEQ ID NO: 113 |
| AAVrh.23 (AAV42.12) | 414 | US20030138772 SEQ ID NO: 58 |
| AAV42.13 | 415 | US20030138772 SEQ ID NO: 86 |
| AAVrh.24 (AAV42.13) | 416 | US20030138772 SEQ ID NO: 31 |
| AAV42.15 | 417 | US20030138772 SEQ ID NO: 84 |
| AAVrh.25 (AAV42.15) | 418 | US20030138772 SEQ ID NO: 28 |
| AAVrh.2R | 419 | US20150159173 |
| AAVrh.31 (AAV223.1) | 420 | US20030138772 SEQ ID NO: 48 |
| AAVC1 | 421 | US20030138772 SEQ ID NO: 60 |
| AAVrh.32 (AAVC1) | 422 | US20030138772 SEQ ID NO: 19 |
| AAVrh.32/33 | 423 | US20150159173 SEQ ID NO: 2 |
| AAVrh.33 (AAVC3) | 424 | US20030138772 SEQ ID NO: 20 |
| AAVC5 | 425 | US20030138772 SEQ ID NO: 62 |
| AAVrh.34 (AAVC5) | 426 | US20030138772 SEQ ID NO: 21 |
| AAVF1 | 427 | US20030138772 SEQ ID NO: 109 |
| AAVrh.35 (AAVF1) | 428 | US20030138772 SEQ ID NO: 22 |
| AAVF3 | 429 | US20030138772 SEQ ID NO: 111 |
| AAVrh.36 (AAVF3) | 430 | US20030138772 SEQ ID NO: 23 |
| AAVrh.37 | 431 | US20030138772 SEQ ID NO: 24 |
| AAVrh.37 | 432 | US20150159173 SEQ ID NO: 40 |
| AAVrh.37 | 433 | US20150315612 SEQ ID NO: 229 |
| AAVrh.37R2 | 434 | US20150159173 |
| AAVrh.38 (AAVLG-4) | 435 | US20150315612 SEQ ID NO: 7 |
| AAVrh.38 (AAVLG-4) | 436 | US20450315612 SEQ ID NO: 86 |
| AAVrh.39 | 437 | US20150159173 SEQ ID NO: 20, US20150315612 SEQ ID NO: 13 |

TABLE 1-continued

AAV Serotypes

| Serotype | SEQ ID NO | Reference Information |
|---|---|---|
| AAVrh.39 | 438 | US20150159173 SEQ ID NO: 3, US20150159173 SEQ ID NO: 36, US20150315612 SEQ ID NO: 89 |
| AAVrh.40 | 439 | US20150315612 SEQ ID NO: 92 |
| AAVrh.40 (AAVLG-10) | 440 | US20150315612 SEQ ID No: 14 |
| AAVrh.43 (AAVN721-8) | 441 | US20150315612 SEQ ID NO: 43, US20150159173 SEQ ID NO: 21 |
| AAVrh.43 (AAVN721-8) | 442 | US20450315612 SEQ ID NO: 163, US20150159173 SEQ ID NO: 37 |
| AAVrh.44 | 443 | US20150315612 SEQ ID NO: 34 |
| AAVrh.44 | 444 | US20150315612 SEQ ID NO: 111 |
| AAVrh.45 | 445 | US20150315612 SEQ ID NO: 41 |
| AAVrh.45 | 446 | US20150315612 SEQ ID NO: 109 |
| AAVrh.46 | 447 | US20150315612 SEQ ID NO: 22, US20150315612 SEQ ID NO: 19 |
| AAVrh.46 | 448 | US20150159173 SEQ ID NO: 4, US20150315612 SEQ ID NO: 101 |
| AAVrh.47 | 449 | US20150315612 SEQ ID NO: 38 |
| AAVrh.47 | 450 | US20150315612 SEQ ID NO: 118 |
| AAVrh.48 | 451 | US20150159173 SEQ ID NO: 44, US20150315612 SEQ ID NO: 115 |
| AAVrh.48.1 | 452 | US20150159173 |
| AAVrh.48.1.2 | 453 | US20150159173 |
| AAVrh.48.2 | 454 | US20150159173 |
| AAVrh.48 (AAV1-7) | 455 | US20150315612 SEQ ID NO: 32 |
| AAVrh.49 (AAV1-8) | 456 | US20150315612 SEQ ID NO: 25 |
| AAVrh.49 (AAV1-8) | 457 | US20150315612 SEQ ID NO: 103 |
| AAVrh.50 (AAV2-4) | 458 | US20150315612 SEQ ID NO: 23 |
| AAVrh.50 (AAV2-4) | 459 | US20150315612 SEQ ID NO: 108 |
| AAVrh.51 (AAV2-5) | 460 | US20150315612 SEQ ID No: 22 |
| AAVrh.51 (AAV2-5) | 461 | US20150315612 SEQ ID NO: 104 |
| AAVrh.52 (AAV3-9) | 462 | US20150315612 SEQ ID NO: 18 |
| AAVrh.52 (AAV3-9) | 463 | US20150315612 SEQ ID NO: 96 |
| AAVrh.53 | 464 | US20150315612 SEQ ID NO: 97 |
| AAVrh.53 (AAV3-11) | 465 | US20150315612 SEQ ID NO: 17 |
| AAVrh.53 (AAV3-11) | 466 | US20150315612 SEQ ID NO: 186 |
| AAVrh.54 | 467 | US20150315612 SEQ ID NO: 40 |
| AAVrh.54 | 468 | US20150159173 SEQ ID NO: 49, US20150315612 SEQ ID NO: 116 |
| AAVrh.55 | 469 | US20150315612 SEQ ID NO: 37 |
| AAVrh.55 (AAV4-19) | 470 | US20150315612 SEQ ID NO: 117 |
| AAVrh.56 | 471 | US20150315612 SEQ ID NO: 54 |
| AAVrh.56 | 472 | US20150315612 SEQ ID NO: 152 |
| AAVrh.57 | 473 | US20150315612 SEQ ID NO: 26 |
| AAVrh.57 | 474 | US20150315612 SEQ ID NO: 105 |
| AAVrh.58 | 475 | US20150315612 SEQ ID NO: 27 |
| AAVrh.58 | 476 | US20150159173 SEQ ID NO: 48, US20150315612 SEQ ID NO: 106 |
| AAVrh.58 | 477 | US20150315612 SEQ ID NO: 232 |
| AAVrh.59 | 478 | US20150315612 SEQ ID NO: 42 |
| AAVrh.59 | 479 | US20150315612 SEQ ID NO: 110 |
| AAVrh.60 | 480 | US20150315612 SEQ ID NO: 31 |
| AAVrh.60 | 481 | US20150315612 SEQ ID NO: 120 |
| AAVrh.61 | 482 | US20150315612 SEQ ID NO: 107 |
| AAVrh.61 (AAV2-3) | 483 | US20150315612 SEQ ID NO: 21 |
| AAVrh.62 (AAV2-15) | 484 | US20150315612 SEQ ID No: 33 |
| AAVrh.62 (AAV2-15) | 485 | US20150315612 SEQ ID NO: 114 |
| AAVrh.64 | 486 | US20150315612 SEQ ID No: 15 |
| AAVrh.64 | 487 | US20150159173 SEQ ID NO: 43, US20150315612 SEQ ID NO: 99 |
| AAVrh.64 | 488 | US20150315612 SEQ ID NO: 233 |
| AAVRh.64R1 | 489 | US20150159173 |
| AAVRh.64R2 | 490 | US20150159173 |
| AAVrh.65 | 491 | US20150315612 SEQ ID NO: 35 |
| AAVrh.65 | 492 | US20150315612 SEQ ID NO: 112 |
| AAVrh.67 | 493 | US20150315612 SEQ ID NO: 36 |
| AAVrh.67 | 494 | US20150315612 SEQ ID NO: 230 |
| AAVrh.67 | 495 | US20150159173 SEQ ID NO: 47, US20150315612 SEQ ID NO: 113 |
| AAVrh.68 | 496 | US20150315612 SEQ ID NO: 16 |
| AAVrh.68 | 497 | US20150315612 SEQ ID NO: 100 |
| AAVrh.69 | 498 | US20150315612 SEQ ID NO: 39 |
| AAVrh.69 | 499 | US20150315612 SEQ ID NO: 119 |
| AAVrh.70 | 500 | US20150315612 SEQ ID NO: 20 |
| AAVrh.70 | 501 | US20150315612 SEQ ID NO: 98 |
| AAVrh.71 | 502 | US20150315612 SEQ ID NO: 162 |
| AAVrh.72 | 503 | US20150315612 SEQ ID NO: 9 |
| AAVrh.73 | 504 | US20150159173 SEQ ID NO: 5 |
| AAVrh.74 | 505 | US20150159173 SEQ ID NO: 6 |
| AAVrh.8 | 506 | US20150159173 SEQ ID NO: 41 |
| AAVrh.8 | 507 | US20150315612 SEQ ID NO: 235 |
| AAVrh.8R | 508 | US20150159173, WO2015168666 SEQ ID NO: 9 |
| AAVrh.8R A586R mutant | 509 | WO2015168666 SEQ ID NO: 10 |
| AAVrh.8R R533A mutant | 510 | WO2015168666 SEQ ID NO: 11 |
| BAAV (bovine AAV) | 511 | U.S. Pat. No. 9,193,769 SEQ ID NO: 8 |
| BAAV (bovine AAV) | 512 | U.S. Pat. No. 9,193,769 SEQ ID NO: 10 |
| BAAV (bovine AAV) | 513 | U.S. Pat. No. 9,193,769 SEQ ID NO: 4 |
| BAAV (bovine AAV) | 514 | U.S. Pat. No. 9,193,769 SEQ ID NO: 2 |
| BAAV (bovine AAV) | 515 | U.S. Pat. No. 9,193,769 SEQ ID NO: 6 |
| BAAV (bovine AAV) | 516 | U.S. Pat. No. 9,193,769 SEQ ID NO: 1 |
| BAAV (bovine AAV) | 517 | U.S. Pat. No. 9,193,769 SEQ ID NO: 5 |
| BAAV (bovine AAV) | 518 | U.S. Pat. No. 9,193,769 SEQ ID NO: 3 |
| BAAV (bovine AAV) | 519 | U.S. Pat. No. 9,193,769 SEQ ID NO: 11 |
| BAAV (bovine AAV) | 520 | U.S. Pat. No. 7,427,396 SEQ ID NO: 5 |
| BAAV (bovine AAV) | 521 | U.S. Pat. No. 7,427,396 SEQ ID NO: 6 |
| BAAV (bovine AAV) | 522 | U.S. Pat. No. 9,193,769 SEQ ID NO: 7 |
| BAAV (bovine AAV) | 523 | U.S. Pat. No. 9,193,769 SEQ ID NO: 9 |
| BNP61 AAV | 524 | US20150238550 SEQ ID NO: 1 |
| BNP61 AAV | 525 | US20150238550 SEQ ID NO: 2 |
| BNP62 AAV | 526 | US20150238550 SEQ ID NO: 3 |
| BNP63 AAV | 527 | US20150238550 SEQ ID NO: 4 |

TABLE 1-continued

AAV Serotypes

| Serotype | SEQ ID NO | Reference Information |
|---|---|---|
| caprine AAV | 528 | U.S. Pat. No. 7,427,396 SEQ ID NO: 3 |
| caprine AAV | 529 | U.S. Pat. No. 7,427,396 SEQ ID NO: 4 |
| true type AAV (ttAAV) | 530 | WO2015121501 SEQ ID NO: 2 |
| AAAV (Avian AAV) | 531 | U.S. Pat. No. 9,238,800 SEQ ID NO: 12 |
| AAAV (Avian AAV) | 532 | U.S. Pat. No. 9,238,800 SEQ ID NO: 2 |
| AAAV (Avian AAV) | 533 | U.S. Pat. No. 9,238,800 SEQ ID NO: 6 |
| AAAV (Avian AAV) | 534 | U.S. Pat. No. 9,238,800 SEQ ID NO: 4 |
| AAAV (Avian AAV) | 535 | U.S. Pat. No. 9,238,800 SEQ ID NO: 8 |
| AAAV (Avian AAV) | 536 | U.S. Pat. No. 9,238,800 SEQ ID NO: 14 |
| AAAV (Avian AAV) | 537 | U.S. Pat. No. 9,238,800 SEQ ID NO: 10 |
| AAAV (Avian AAV) | 538 | U.S. Pat. No. 9,238,800 SEQ ID NO: 15 |
| AAAV (Avian AAV) | 539 | U.S. Pat. No. 9,238,800 SEQ ID NO: 5 |
| AAAV (Avian AAV) | 540 | U.S. Pat. No. 9,238,800 SEQ ID NO: 9 |
| AAAV (Avian AAV) | 541 | U.S. Pat. No. 9,238,800 SEQ ID NO: 3 |
| AAAV (Avian AAV) | 542 | U.S. Pat. No. 9,238,800 SEQ ID NO: 7 |
| AAAV (Avian AAV) | 543 | U.S. Pat. No. 9,238,800 SEQ ID NO: 11 |
| AAAV (Avian AAV) | 544 | U.S. Pat. No. 9,238,800 SEQ ID NO: 13 |
| AAAV (Avian AAV) | 545 | U.S. Pat. No. 9,238,800 SEQ ID NO: 1 |
| AAV Shuffle 100-1 | 546 | US20160017295 SEQ ID NO: 23 |
| AAV Shuffle 100-1 | 547 | US20160017295 SEQ ID NO: 11 |
| AAV Shuffle 100-2 | 548 | US20160017295 SEQ ID NO: 37 |
| AAV Shuffle 100-2 | 549 | US20160017295 SEQ ID NO: 29 |
| AAV Shuffle 100-3 | 550 | US20160017295 SEQ ID NO: 24 |
| AAV Shuffle 100-3 | 551 | US20160017295 SEQ ID NO: 12 |
| AAV Shuffle 100-7 | 552 | US20160017295 SEQ ID NO: 25 |
| AAV Shuffle 100-7 | 553 | US20160017295 SEQ ID NO: 13 |
| AAV Shuffle 10-2 | 554 | US20160017295 SEQ ID NO: 34 |
| AAV Shuffle 10-2 | 555 | US20160017295 SEQ ID NO: 26 |
| AAV Shuffle 10-6 | 556 | US20160017295 SEQ ID NO: 35 |
| AAV Shuffle 10-6 | 557 | US20160017295 SEQ ID NO: 27 |
| AAV Shuffle 10-8 | 558 | US20160017295 SEQ ID NO: 36 |
| AAV Shuffle 10-8 | 559 | US20160017295 SEQ ID NO: 28 |
| AAV SM 100-10 | 560 | US20160017295 SEQ ID NO: 41 |
| AAV SM 100-10 | 561 | US20160017295 SEQ ID NO: 33 |
| AAV SM 100-3 | 562 | US20160017295 SEQ ID NO: 40 |
| AAV SM 100-3 | 563 | US20160017295 SEQ ID NO: 32 |
| AAV SM 10-1 | 564 | US20160017295 SEQ ID NO: 38 |
| AAV SM 10-1 | 565 | US20160017295 SEQ ID NO: 30 |
| AAV SM 10-2 | 566 | US20160017295 SEQ ID NO: 10 |
| AAV SM 10-2 | 567 | US20160017295 SEQ ID NO: 22 |
| AAV SM 10-8 | 568 | US20160017295 SEQ ID NO: 39 |
| AAV SM 10-8 | 569 | US20160017295 SEQ ID NO: 31 |
| AAV SM 100-10 | 560 | US20160017295 SEQ ID NO: 41 |
| AAV SM 100-10 | 561 | US20160017295 SEQ ID NO: 33 |
| AAV SM 100-3 | 562 | US20160017295 SEQ ID NO: 40 |
| AAV SM 100-3 | 563 | US20160017295 SEQ ID NO: 32 |
| AAV SM 10-1 | 564 | US20160017295 SEQ ID NO: 38 |
| AAV SM 10-1 | 565 | US20160017295 SEQ ID NO: 30 |
| AAV SM 10-2 | 566 | US20160017295 SEQ ID NO: 10 |
| AAV SM 10-2 | 567 | US20160017295 SEQ ID NO: 22 |
| AAV SM 10-8 | 568 | US20160017295 SEQ ID NO: 39 |
| AAV SM 10-8 | 569 | US20160017295 SEQ ID NO: 31 |
| AAVF1/HSC1 | 570 | WO2016049230 SEQ ID NO: 20 |
| AAVF2/HSC2 | 571 | WO2016049230 SEQ ID NO: 21 |
| AAVF3/HSC3 | 572 | WO2016049230 SEQ ID NO: 22 |
| AAVF4/HSC4 | 573 | WO2016049230 SEQ ID NO: 23 |
| AAVF5/HSC5 | 574 | WO2016049230 SEQ ID NO: 25 |
| AAVF6/HSC6 | 575 | WO2016049230 SEQ ID NO: 24 |
| AAVF7/HSC7 | 576 | WO2016049230 SEQ ID NO: 27 |
| AAVF8/HSC8 | 577 | WO2016049230 SEQ ID NO: 28 |
| AAVF9/HSC9 | 578 | WO2016049230 SEQ ID NO: 29 |
| AAVF11/HSC11 | 579 | WO2016049230 SEQ ID NO: 26 |
| AAVF12/HSC12 | 580 | WO2016049230 SEQ ID NO: 30 |
| AAVF13/HSC13 | 581 | WO2016049230 SEQ ID NO: 31 |
| AAVF14/HSC14 | 582 | WO2016049230 SEQ ID NO: 32 |
| AAVF15/HSC15 | 583 | WO2016049230 SEQ ID NO: 33 |
| AAVF16/HSC16 | 584 | WO2016049230 SEQ ID NO: 34 |
| AAVF17/HSC17 | 585 | WO2016049230 SEQ ID NO: 35 |
| AAVF1/HSC1 | 586 | WO2016049230 SEQ ID NO: 2 |
| AAVF2/HSC2 | 587 | WO2016049230 SEQ ID NO: 3 |
| AAVF3/HSC3 | 588 | WO2016049230 SEQ ID NO: 5 |
| AAVF4/HSC4 | 589 | WO2016049230 SEQ ID NO: 6 |
| AAVF5/HSC5 | 590 | WO2016049230 SEQ ID NO: 11 |
| AAVF6/HSC6 | 591 | WO2016049230 SEQ ID NO: 7 |
| AAVF7/HSC7 | 592 | WO2016049230 SEQ ID NO: 8 |
| AAVF8/HSC8 | 593 | WO2016049230 SEQ ID NO: 9 |
| AAVF9/HSC9 | 594 | WO2016049230 SEQ ID NO: 10 |
| AAVF11/HSC11 | 595 | WO2016049230 SEQ ID NO: 4 |
| AAVF12/HSC12 | 596 | WO2016049230 SEQ ID NO: 12 |
| AAVF13/HSC13 | 597 | WO2016049230 SEQ ID NO: 14 |
| AAVF14/HSC14 | 598 | WO2016049230 SEQ ID NO: 15 |

TABLE 1-continued

AAV Serotypes

| Serotype | SEQ ID NO | Reference Information |
|---|---|---|
| AAVF15/HSC15 | 599 | WO2016049230 SEQ ID NO: 16 |
| AAVF16/HSC16 | 600 | WO2016049230 SEQ ID NO: 17 |
| AAVF17/HSC17 | 601 | WO2016149230 SEQ ID NO: 13 |
| AAV CBr-E1 | 602 | U.S. Pat. No. 8,734,809 SEQ ID NO: 13 |
| AAV CBr-E2 | 603 | U.S. Pat. No. 8,734,809 SEQ ID NO: 14 |
| AAV CBr-E3 | 604 | U.S. Pat. No. 8,734,809 SEQ ID NO: 15 |
| AAV CBr-E4 | 605 | U.S. Pat. No. 8,734,809 SEQ ID NO: 16 |
| AAV CBr-E5 | 606 | U.S. Pat. No. 8,734,809 SEQ ID NO: 17 |
| AAV CBr-e5 | 607 | U.S. Pat. No. 8,734,809 SEQ ID NO: 18 |
| AAV CBr-E6 | 608 | U.S. Pat. No. 8,734,809 SEQ ID NO: 19 |
| AAV CBr-E7 | 609 | U.S. Pat. No. 8,734,809 SEQ ID NO: 20 |
| AAV CBr-E8 | 610 | U.S. Pat. No. 8,734,809 SEQ ID NO: 21 |
| AAV CLv-D1 | 611 | U.S. Pat. No. 8,734,809 SEQ ID NO: 22 |
| AAV CLv-D2 | 612 | U.S. Pat. No. 8,734,809 SEQ ID NO: 23 |
| AAV CLv-D3 | 613 | U.S. Pat. No. 8,734,809 SEQ ID NO: 24 |
| AAV CLv-D4 | 614 | U.S. Pat. No. 8,734,809 SEQ ID NO: 25 |
| AAV CLv-D5 | 615 | U.S. Pat. No. 8,734,809 SEQ ID NO: 26 |
| AAV CLv-D6 | 616 | U.S. Pat. No. 8,734,809 SEQ ID NO: 27 |
| AAV CLv-D7 | 617 | U.S. Pat. No. 8,734,809 SEQ ID NO: 28 |
| AAV CLv-D8 | 618 | U.S. Pat. No. 8,734,809 SEQ ID NO: 29 |
| AAV CLv-E1 | 619 | U.S. Pat. No. 8,734,809 SEQ ID NO: 13 |
| AAV CLv-R1 | 620 | U.S. Pat. No. 8,734,809 SEQ ID NO: 30 |
| AAV CLv-R2 | 621 | U.S. Pat. No. 8,734,809 SEQ ID NO: 31 |
| AAV CLv-R3 | 622 | U.S. Pat. No. 8,734,809 SEQ ID NO: 32 |
| AAV CLv-R4 | 623 | U.S. Pat. No. 8,734,809 SEQ ID NO: 33 |
| AAV CLv-R5 | 624 | U.S. Pat. No. 8,734,809 SEQ ID NO: 34 |
| AAV CLv-R6 | 625 | U.S. Pat. No. 8,734,809 SEQ ID NO: 35 |
| AAV CLv-R7 | 626 | U.S. Pat. No. 8,734,809 SEQ ID NO: 36 |
| AAV CLv-R8 | 627 | U.S. Pat. No. 8,734,809 SEQ ID NO: 37 |
| AAV CLv-R9 | 628 | U.S. Pat. No. 8,734,809 SEQ ID NO: 38 |
| AAV CLg-F1 | 629 | U.S. Pat. No. 8,734,809 SEQ ID NO: 39 |
| AAV CLg-F2 | 630 | U.S. Pat. No. 8,734,809 SEQ ID NO: 40 |
| AAV CLg-F3 | 631 | U.S. Pat. No. 8,734,809 SEQ ID NO: 41 |
| AAV CLg-F4 | 632 | U.S. Pat. No. 8,734,809 SEQ ID NO: 42 |
| AAV CLg-F5 | 633 | U.S. Pat. No. 8,734,809 SEQ ID NO: 43 |
| AAV CLg-F6 | 634 | U.S. Pat. No. 8,734,809 SEQ ID NO: 43 |
| AAV CLg-F7 | 635 | U.S. Pat. No. 8,734,809 SEQ ID NO: 44 |
| AAV CLg-F8 | 636 | U.S. Pat. No. 8,734,809 SEQ ID NO: 43 |
| AAV CSp-1 | 637 | U.S. Pat. No. 8,734,809 SEQ ID NO: 45 |
| AAV CSp-10 | 638 | U.S. Pat. No. 8,734,809 SEQ ID NO: 46 |
| AAV CSp-11 | 639 | U.S. Pat. No. 8,734,809 SEQ ID NO: 47 |
| AAV CSp-2 | 640 | U.S. Pat. No. 8,734,809 SEQ ID NO: 48 |
| AAV CSp-3 | 641 | U.S. Pat. No. 8,734,809 SEQ ID NO: 49 |
| AAV CSp-4 | 642 | U.S. Pat. No. 8,734,809 SEQ ID NO: 50 |
| AAV CSp-6 | 643 | U.S. Pat. No. 8,734,809 SEQ ID NO: 51 |
| AAV CSp-7 | 644 | U.S. Pat. No. 8,734,809 SEQ ID NO: 52 |
| AAV CSp-8 | 645 | U.S. Pat. No. 8,734,809 SEQ ID NO: 53 |
| AAV CSp-9 | 646 | U.S. Pat. No. 8,734,809 SEQ ID NO: 54 |
| AAV CHt-2 | 647 | U.S. Pat. No. 8,734,809 SEQ ID NO: 55 |
| AAV CHt-3 | 648 | U.S. Pat. No. 8,734,809 SEQ ID NO: 56 |
| AAV CKd-1 | 649 | U.S. Pat. No. 8,734,809 SEQ ID NO: 57 |
| AAV CKd-10 | 650 | U.S. Pat. No. 8,734,809 SEQ ID NO: 58 |
| AAV CKd-2 | 651 | U.S. Pat. No. 8,734,809 SEQ ID NO: 59 |
| AAV CKd-3 | 652 | U.S. Pat. No. 8,734,809 SEQ ID NO: 60 |
| AAV CKd-4 | 653 | U.S. Pat. No. 8,734,809 SEQ ID NO: 61 |
| AAV CKd-6 | 654 | U.S. Pat. No. 8,734,809 SEQ ID NO: 62 |
| AAV CKd-7 | 655 | U.S. Pat. No. 8,734,809 SEQ ID NO: 63 |
| AAV CKd-8 | 656 | U.S. Pat. No. 8,734,809 SEQ ID NO: 64 |
| AAV CLv-1 | 657 | U.S. Pat. No. 8,734,809 SEQ ID NO: 65 |
| AAV CLv-12 | 658 | U.S. Pat. No. 8,734,809 SEQ ID NO: 66 |
| AAV CLv-13 | 659 | U.S. Pat. No. 8,734,809 SEQ ID NO: 67 |
| AAV CLv-2 | 660 | U.S. Pat. No. 8,734,809 SEQ ID NO: 68 |
| AAV CLv-3 | 661 | U.S. Pat. No. 8,734,809 SEQ ID NO: 69 |
| AAV CLv-4 | 662 | U.S. Pat. No. 8,734,809 SEQ ID NO: 70 |
| AAV CLv-6 | 663 | U.S. Pat. No. 8,734,809 SEQ ID NO: 71 |
| AAV CLv-8 | 664 | U.S. Pat. No. 8,734,809 SEQ ID NO: 72 |
| AAV CKd-B1 | 665 | U.S. Pat. No. 8,734,809 SEQ ID NO: 73 |
| AAV CKd-B2 | 666 | U.S. Pat. No. 8,734,809 SEQ ID NO: 74 |
| AAV CKd-B3 | 667 | U.S. Pat. No. 8,734,809 SEQ ID NO: 75 |
| AAV CKd-B4 | 668 | U.S. Pat. No. 8,734,809 SEQ ID NO: 76 |
| AAV CKd-B5 | 669 | U.S. Pat. No. 8,734,809 SEQ ID NO: 77 |
| AAV CKd-B6 | 670 | U.S. Pat. No. 8,734,809 SEQ ID NO: 78 |
| AAV CKd-B7 | 671 | U.S. Pat. No. 8,734,809 SEQ ID NO: 79 |
| AAV CKd-B8 | 672 | U.S. Pat. No. 8,734,809 SEQ ID NO: 80 |
| AAV CKd-H1 | 673 | U.S. Pat. No. 8,734,809 SEQ ID NO: 81 |
| AAV CKd-H2 | 674 | U.S. Pat. No. 8,734,809 SEQ ID NO: 82 |
| AAV CKd-H3 | 675 | U.S. Pat. No. 8,734,809 SEQ ID NO: 83 |
| AAV CKd-H4 | 676 | U.S. Pat. No. 8,734,809 SEQ ID NO: 84 |
| AAV CKd-H5 | 677 | U.S. Pat. No. 8,734,809 SEQ ID NO: 85 |
| AAV CKd-H6 | 678 | U.S. Pat. No. 8,734,809 SEQ ID NO: 77 |
| AAV CHt-1 | 679 | U.S. Pat. No. 8,734,809 SEQ ID NO: 86 |
| AAV CLv1-1 | 680 | U.S. Pat. No. 8,734,809 SEQ ID NO: 171 |
| AAV CLv1-2 | 681 | U.S. Pat. No. 8,734,809 SEQ ID NO: 172 |
| AAV CLv1-3 | 682 | U.S. Pat. No. 8,734,809 SEQ ID NO: 173 |
| AAV CLv1-4 | 683 | U.S. Pat. No. 8,734,809 SEQ ID NO: 174 |
| AAV CLv1-7 | 684 | U.S. Pat. No. 8,734,809 SEQ ID NO: 175 |
| AAV CLv1-8 | 685 | U.S. Pat. No. 8,734,809 SEQ ID NO: 176 |
| AAV CLv1-9 | 686 | U.S. Pat. No. 8,734,809 SEQ ID NO: 177 |
| AAV CLv1-10 | 687 | U.S. Pat. No. 8,734,809 SEQ ID NO: 178 |
| AAV.VR-355 | 688 | U.S. Pat. No. 8,734,809 SEQ ID NO: 181 |
| AAV.hu.48R3 | 689 | U.S. Pat. No. 8,734,809 SEQ ID NO: 183 |
| AAV CBr-E1 | 690 | U.S. Pat. No. 8,734,809 SEQ ID NO: 87 |
| AAV CBr-E2 | 691 | U.S. Pat. No. 8,734,809 SEQ ID NO: 88 |
| AAV CBr-E3 | 692 | U.S. Pat. No. 8,734,809 SEQ ID NO: 89 |
| AAV CBr-E4 | 693 | U.S. Pat. No. 8,734,809 SEQ ID NO: 90 |
| AAV CBr-E5 | 694 | U.S. Pat. No. 8,734,809 SEQ 11 ID NO: 91 |
| AAV CBr-e5 | 695 | U.S. Pat. No. 8,734,809 SEQ ID NO: 92 |
| AAV CBr-E6 | 696 | U.S. Pat. No. 8,734,809 SEQ ID NO: 93 |
| AAV CBr-E7 | 697 | U.S. Pat. No. 8,734,809 SEQ ID NO: 94 |
| AAV CBr-E8 | 698 | U.S. Pat. No. 8,734,809 SEQ ID NO: 95 |
| AAV CLv-D1 | 699 | U.S. Pat. No. 8,734,809 SEQ ID NO: 96 |
| AAV CLv-D2 | 700 | U.S. Pat. No. 8,734,809 SEQ ID NO: 97 |
| AAV CLv-D3 | 701 | U.S. Pat. No. 8,734,809 SEQ ID NO: 98 |
| AAV CLv-D4 | 702 | U.S. Pat. No. 8,734,809 SEQ ID NO: 99 |
| AAV CLv-D5 | 703 | U.S. Pat. No. 8,734,809 SEQ ID NO: 100 |
| AAV CLv-D6 | 704 | U.S. Pat. No. 8,734,809 SEQ ID NO: 101 |

TABLE 1-continued

AAV Serotypes

| Serotype | SEQ ID NO | Reference Information |
|---|---|---|
| AAV CLv-D7 | 705 | U.S. Pat. No. 8,734,809 SEQ ID NO: 102 |
| AAV CLv-D8 | 706 | U.S. Pat. No. 8,734,809 SEQ ID NO: 103 |
| AAV CLv-E1 | 707 | U.S. Pat. No. 8,734,809 SEQ ID NO: 87 |
| AAV CLv-R1 | 708 | U.S. Pat. No. 8,734,809 SEQ ID NO: 104 |
| AAV CLv-R2 | 709 | U.S. Pat. No. 8,734,809 SEQ ID NO: 105 |
| AAV CLv-R3 | 710 | U.S. Pat. No. 8,734,809 SEQ ID NO: 106 |
| AAV CLv-R4 | 711 | U.S. Pat. No. 8,734,809 SEQ ID NO: 107 |
| AAV CLv-R5 | 712 | U.S. Pat. No. 8,734,809 SEQ ID NO: 108 |
| AAV CLv-R6 | 713 | U.S. Pat. No. 8,734,809 SEQ ID NO: 109 |
| AAV CLv-R7 | 714 | U.S. Pat. No. 8,734,809 SEQ ID NO: 110 |
| AAV CLv-R8 | 715 | U.S. Pat. No. 8,734,809 SEQ ID NO: 111 |
| AAV CLv-R9 | 716 | U.S. Pat. No. 8,734,809 SEQ ID NO: 112 |
| AAV CLg-F1 | 717 | U.S. Pat. No. 8,734,809 SEQ ID NO: 113 |
| AAV CLg-F2 | 718 | U.S. Pat. No. 8,734,809 SEQ ID NO: 114 |
| AAV CLg-F3 | 719 | U.S. Pat. No. 8,734,809 SEQ ID NO: 115 |
| AAV CLg-74 | 720 | U.S. Pat. No. 8,734,809 SEQ ID NO: 116 |
| AAV CLg-F5 | 721 | U.S. Pat. No. 8,734,809 SEQ ID NO: 117 |
| AAV CLg-F6 | 722 | U.S. Pat. No. 8,734,809 SEQ ID NO: 117 |
| AAV CLg-F7 | 723 | U.S. Pat. No. 8,734,809 SEQ ID NO: 118 |
| AAV CLg-F8 | 724 | U.S. Pat. No. 8,734,809 SEQ ID NO: 117 |
| AAV CSp-1 | 725 | U.S. Pat. No. 8,734,809 SEQ ID NO: 119 |
| AAV CSp-10 | 726 | U.S. Pat. No. 8,734,809 SEQ ID NO: 120 |
| AAV CSp-11 | 727 | U.S. Pat. No. 8,734,809 SEQ ID NO: 121 |
| AAV CSp-2 | 728 | U.S. Pat. No. 8,734,809 SEQ ID NO: 122 |
| AAV CSp-3 | 729 | U.S. Pat. No. 8,734,809 SEQ ID NO: 123 |
| AAV CSp-4 | 730 | U.S. Pat. No. 8,734,809 SEQ ID NO: 124 |
| AAV CSp-6 | 731 | U.S. Pat. No. 8,734,809 SEQ ID NO: 125 |
| AAV CSp-7 | 732 | U.S. Pat. No. 8,734,809 SEQ ID NO: 126 |
| AAV CSp-8 | 733 | U.S. Pat. No. 8,734,809 SEQ ID NO: 127 |
| AAV CSp-9 | 734 | U.S. Pat. No. 8,734,809 SEQ ID NO: 128 |
| AAV CHt-2 | 735 | U.S. Pat. No. 8,734,809 SEQ ID NO: 129 |
| AAV CHt-3 | 736 | U.S. Pat. No. 8,734,809 SEQ ID NO: 130 |
| AAV CKd-1 | 737 | U.S. Pat. No. 8,734,809 SEQ ID NO: 131 |
| AAV CKd-10 | 738 | U.S. Pat. No. 8,734,809 SEQ ID NO: 132 |
| AAV CKd-2 | 739 | U.S. Pat. No. 8,734,809 SEQ ID NO: 133 |
| AAV CKd-3 | 740 | U.S. Pat. No. 8,734,809 SEQ ID NO: 134 |
| AAV CKd-4 | 741 | U.S. Pat. No. 8,734,809 SEQ ID NO: 135 |
| AAV CKd-6 | 742 | U.S. Pat. No. 8,734,809 SEQ ID NO: 136 |
| AAV CKd-7 | 743 | U.S. Pat. No. 8,734,809 SEQ ID NO: 137 |
| AAV CKd-8 | 744 | U.S. Pat. No. 8,734,809 SEQ ID NO: 138 |
| AAV CLv-1 | 745 | U.S. Pat. No. 8,734,809 SEQ ID NO: 139 |
| AAV CLv-12 | 746 | U.S. Pat. No. 8,734,809 SEQ ID NO: 140 |
| AAV CLv-13 | 747 | U.S. Pat. No. 8,734,809 SEQ ID NO: 141 |
| AAV CLv-2 | 748 | U.S. Pat. No. 8,734,809 SEQ ID NO: 142 |
| AAV CLv-3 | 749 | U.S. Pat. No. 8,734,809 SEQ ID NO: 143 |
| AAV CLv-4 | 750 | U.S. Pat. No. 8,734,809 SEQ ID NO: 144 |
| AAV CLv-6 | 751 | U.S. Pat. No. 8,734,809 SEQ ID NO: 145 |
| AAV CLv-8 | 752 | U.S. Pat. No. 8,734,809 SEQ ID NO: 146 |
| AAV CKd-B1 | 753 | U.S. Pat. No. 8,734,809 SEQ ID NO: 147 |
| AAV CKd-B3 | 754 | U.S. Pat. No. 8,734,809 SEQ ID NO: 148 |
| AAV CKd-B3 | 755 | U.S. Pat. No. 8,734,809 SEQ ID NO: 149 |
| AAV CKd-B4 | 756 | U.S. Pat. No. 8,734,809 SEQ ID NO: 150 |
| AAV CKd-B5 | 757 | U.S. Pat. No. 8,734,809 SEQ ID NO: 151 |
| AAV CKd-B6 | 758 | U.S. Pat. No. 8,734,809 SEQ ID NO: 152 |
| AAV CKd-B7 | 759 | U.S. Pat. No. 8,734,809 SEQ ID NO: 153 |
| AAV CKd-B8 | 760 | U.S. Pat. No. 8,734,809 SEQ ID NO: 154 |
| AAV CKd-H1 | 761 | U.S. Pat. No. 8,734,809 SEQ ID NO: 155 |
| AAV CKd-H2 | 762 | U.S. Pat. No. 8,734,809 SEQ ID NO: 156 |
| AAV CKd-H3 | 763 | U.S. Pat. No. 8,734,809 SEQ ID NO: 157 |
| AAV CKd-H4 | 764 | U.S. Pat. No. 8,734,809 SEQ ID NO: 158 |
| AAV CKd-H5 | 765 | U.S. Pat. No. 8,734,809 SEQ ID NO: 159 |
| AAV CKd-H6 | 766 | U.S. Pat. No. 8,734,809 SEQ ID NO: 151 |
| AAV CHt-1 | 767 | U.S. Pat. No. 8,734,809 SEQ ID NO: 160 |
| AAV CHt-P2 | 768 | WO2016065001 SEQ ID NO: 1 |
| AAV CHt-P5 | 769 | WO2016065001 SEQ ID NO: 2 |
| AAV CHt-P9 | 770 | WO2016065001 SEQ ID NO: 3 |
| AAV CBr-7.1 | 771 | WO2016065001 SEQ ID NO: 4 |
| AAV CBr-7.2 | 772 | WO2016065001 SEQ ID NO: 5 |
| AAV CBr-7.3 | 773 | WO2016065001 SEQ ID NO: 6 |
| AAV CBr-7.4 | 774 | WO2016065001 SEQ ID NO: 7 |
| AAV CBr-7.5 | 775 | WO2016065001 SEQ ID NO: 8 |
| AAV CBr-7.7 | 776 | WO2016065001 SEQ ID NO: 9 |
| AAV CBr-7.8 | 777 | WO2016065001 SEQ ID NO: 10 |
| AAV CBr-7.10 | 778 | WO2016065001 SEQ ID NO: 11 |
| AAV CKd-N3 | 779 | WO2016065001 SEQ ID NO: 12 |
| AAV CKd-N4 | 780 | WO2016065001 SEQ ID NO: 13 |
| AAV CKd-N9 | 781 | WO2016065001 SEQ ID NO: 14 |
| AAV CLv-L4 | 782 | WO2016065001 SEQ ID NO: 15 |
| AAV CLv-L5 | 783 | WO2016065001 SEQ ID NO: 16 |
| AAV CLv-L6 | 784 | WO2016065001 SEQ ID NO: 17 |
| AAV CLv-K1 | 785 | WO2016065001 SEQ ID NO: 18 |
| AAV CLv-K3 | 786 | WO2016065001 SEQ ID NO: 19 |
| AAV CLv-K6 | 787 | WO2016065001 SEQ ID NO: 20 |
| AAV CLv-M1 | 788 | WO2016065001 SEQ ID NO: 21 |
| AAV CLv-M11 | 789 | WO2016065001 SEQ ID NO: 22 |
| AAV CLv-M2 | 790 | WO2016065001 SEQ ID NO: 23 |
| AAV CLv-M5 | 791 | WO2016065001 SEQ ID NO: 24 |
| AAV CLv-M6 | 792 | WO2016065001 SEQ ID NO: 25 |
| AAV CLv-M7 | 793 | WO2016065001 SEQ ID NO: 26 |
| AAV CLv-M8 | 794 | WO2016065001 SEQ ID NO: 27 |
| AAV CLv-M9 | 795 | WO2016065001 SEQ ID NO: 28 |
| AAV CHt-P1 | 796 | WO2016065001 SEQ ID NO: 29 |
| AAV CHt-P6 | 797 | WO2016065001 SEQ ID NO: 30 |
| AAV CHt-P8 | 798 | WO2016065001 SEQ ID NO: 31 |
| AAV CHt-6.1 | 799 | WO2016065001 SEQ ID NO: 32 |
| AAV CHt-6.10 | 800 | WO2016065001 SEQ ID NO: 33 |
| AAV CHt-6.5 | 801 | WO2016065001 SEQ ID NO: 34 |

TABLE 1-continued

AAV Serotypes

| Serotype | SEQ ID NO | Reference Information |
|---|---|---|
| AAV CHt-6.6 | 802 | WO2016065001 SEQ ID NO: 35 |
| AAV CHt-6.7 | 803 | WO2016065001 SEQ ID NO: 36 |
| AAV CHt-6.8 | 804 | WO2016065001 SEQ ID NO: 37 |
| AAV CSp-8.10 | 805 | WO2016065001 SEQ ID NO: 38 |
| AAV CSp-8.2 | 806 | WO2016065001 SEQ ID NO: 39 |
| AAV CSp-8.4 | 807 | WO2016065001 SEQ ID NO: 40 |
| AAV CSp-8.5 | 808 | WO2016065001 SEQ ID NO: 41 |
| AAV CSp-8.6 | 809 | WO2016065001 SEQ ID NO: 42 |
| AAV CSp-8.7 | 810 | WO2016065001 SEQ ID NO: 43 |
| AAV CSp-8.8 | 811 | WO2016065001 SEQ ID NO: 44 |
| AAV CSp-8.9 | 812 | WO2016065001 SEQ ID NO: 45 |
| AAV CBr-B7.3 | 813 | WO2016065001 SEQ ID NO: 46 |
| AAV CBr-B7.4 | 814 | WO2016065001 SEQ ID NO: 47 |
| AAV3B | 815 | WO2016065001 SEQ ID NO: 48 |
| AAV4 | 816 | WO2016065001 SEQ ID NO: 49 |
| AAV5 | 817 | WO2016065001 SEQ ID NO: 50 |
| AAV CHt-P2 | 818 | WO2016065001 SEQ ID NO: 51 |
| AAV CHt-P5 | 819 | WO2016065001 SEQ ID NO: 52 |
| AAV CHt-P9 | 820 | WO2016065001 SEQ ID NO: 53 |
| AAV CBr-7.1 | 821 | WO2016065001 SEQ ID NO: 54 |
| AAV CBr-7.2 | 822 | WO2016065001 SEQ ID NO: 55 |
| AAV CBr-7.3 | 823 | WO2016065001 SEQ ID NO: 56 |
| AAV CBr-7.4 | 824 | WO2016065001 SEQ ID NO: 57 |
| AAV CBr-7.5 | 825 | WO2016065001 SEQ ID NO: 58 |
| AAV CBr-7.7 | 826 | WO2016065001 SEQ ID NO: 59 |
| AAV CBr-7.8 | 827 | WO2016065001 SEQ ID NO: 60 |
| AAV CBr-7.10 | 828 | WO2016065001 SEQ ID NO: 61 |
| AAV CKd-N3 | 829 | WO2016065001 SEQ ID NO: 62 |
| AAV CKd-N4 | 830 | WO2016065001 SEQ ID NO: 63 |
| AAV CKd-N9 | 831 | WO2016065001 SEQ ID NO: 64 |
| AAV CLv-L4 | 832 | WO2016065001 SEQ ID NO: 65 |
| AAV CLv-L5 | 833 | WO2016065001 SEQ ID NO: 66 |
| AAV CLv-L6 | 834 | WO2016065001 SEQ ID NO: 67 |
| AAV CLv-K1 | 835 | WO2016065001 SEQ ID NO: 68 |
| AAV CLv-K3 | 836 | WO2016065001 SEQ ID NO: 69 |
| AAV CLv-K6 | 837 | WO2016065001 SEQ ID NO: 70 |
| AAV CL-M1 | 838 | WO2016065001 SEQ ID NO: 71 |
| AAV CLv-M11 | 839 | WO2016065001 SEQ ID NO: 72 |
| AAV CLv-M2 | 840 | WO2016065001 SEQ ID NO: 73 |
| AAV CLv-M5 | 841 | WO2016065001 SEQ ID NO: 74 |
| AAV CLv-M6 | 842 | WO2016065001 SEQ ID NO: 75 |
| AAV CLv-M7 | 843 | WO2016065001 SEQ ID NO: 76 |
| AAV CLv-M8 | 844 | WO2016065001 SEQ ID NO: 77 |
| AAV CLv-M9 | 845 | WO2016065001 SEQ ID NO: 78 |
| AAV CHt-P1 | 846 | WO2016065001 SEQ ID NO: 79 |
| AAV CHt-P6 | 847 | WO2016065001 SEQ ID NO: 80 |
| AAV CHt-P8 | 848 | WO2016065001 SEQ ID NO: 81 |
| AAV CHt-6.1 | 849 | WO2016065001 SEQ ID NO: 82 |
| AAV CHt-6.10 | 850 | WO2016065001 SEQ ID NO: 83 |
| AAV CHt-6.5 | 851 | WO2016065001 SEQ ID NO: 84 |
| AAV CHt-6.6 | 852 | WO2016065001 SEQ ID NO: 85 |
| AAV CHt-6.7 | 853 | WO2016065001 SEQ ID NO: 86 |
| AAV CHt-6.8 | 854 | WO2016065001 SEQ ID NO: 87 |
| AAV CSp-8.10 | 855 | WO2016065001 SEQ ID NO: 88 |
| AAV CSp-8.2 | 856 | WO2016i65001 SEQ ID NO: 89 |
| AAV CSp-8.4 | 857 | WO2016065001 SEQ ID NO: 90 |
| AAVTSp-8.5 | 858 | WO2016065001 SEQ ID NO: 91 |
| AAV CSp-8.6 | 859 | WO2016065001 SEQ ID NO: 92 |
| AAV CSp-8.7 | 860 | WO2016065001 SEQ ID NO: 93 |
| AAV CSp-8.8 | 861 | WO2016065001 SEQ ID NO: 94 |
| AAV CSp-8.9 | 862 | WO2016065001 SEQ ID NO: 95 |
| AAV CBr-B7.3 | 863 | WO2016065001 SEQ ID NO: 96 |
| AAV CBr-B7.4 | 864 | WO2016065001 SEQ ID NO: 97 |
| AAV3B | 865 | WO2016065001 SEQ ID NO: 98 |
| AAV4 | 866 | WO2016065001 SEQ ID NO: 99 |
| AAV5 | 867 | WO2016065001 SEQ ID NO: 100 |
| AAVPHP.B or G2B-26 | 868 | WO2015038958 SEQ ID NO: 8 and 13, GenBankALU85156.1 |
| AAVPHP.B | 869 | WO2015038958 SEQ ID NO: 9 |
| AAVG2B-13 | 870 | WO2015038958 SEQ ID NO: 12 |
| AAVTH1.1-32 | 871 | WO2015038958 SEQ ID NO: 14 |
| AAVTH1.1-35 | 872 | WO2015038958 SEQ ID NO: 15 |
| PHP.N/PHP.B-DGT | 1439 | WO2017100671 SEQ ID NO: 46 |
| PHP.S/G2A12 | 1440 | WO2017100671 SEQ ID NO: 47 |
| AAV9/hu.14 K449R | 1441 | WO2017100671 SEQ ID NO: 45 |
| GPV | 1518 | US9624274B2 SEQ ID NO: 192 |
| B19 | 1519 | US9624274B2 SEQ ID NO: 193 |
| MVM | 1520 | US9624274B2 SEQ ID NO: 194 |
| FPV | 1521 | US9624274B2 SEQ ID NO: 195 |
| CPV | 1522 | US9624274B2 SEQ ID NO: 196 |
| AAV6 | 1523 | US9546112B2 SEQ ID NO: 5 |
| AAV6 | 1524 | US9457103B2 SEQ ID NO: 1 |
| AAV2 | 1525 | US9457103B2 SEQ ID NO: 2 |
| ShH10 | 1526 | US9457103B2 SEQ ID NO: 3 |
| ShH13 | 1527 | US9457103B2 SEQ ID NO: 4 |
| ShH10 | 1528 | US9457103B2 SEQ ID NO: 5 |
| ShH10 | 1529 | US9457103B2 SEQ ID NO: 6 |
| ShH10 | 1530 | US9457103B2 SEQ ID NO: 7 |
| ShH10 | 1531 | US9457103B2 SEQ ID NO: 8 |

TABLE 1-continued

AAV Serotypes

| Serotype | SEQ ID NO | Reference Information |
|---|---|---|
| ShH10 | 1532 | US9457103B2 SEQ ID NO: 9 |
| rh74 | 1533 | US9434928B2 SEQ ID NO: 1, US2015023924A1 SEQ ID NO: 2 |
| rh74 | 1534 | US9434928B2 SEQ ID NO: 2, US2015023924A1 SEQ ID NO: 1 |
| AAV8 | 1535 | US9434928B2 SEQ ID NO: 4 |
| rh74 | 1536 | US9434928B2 SEQ ID NO: 5 |
| rh74 (RHM4-1) | 1537 | US2015023924A1 SEQ ID NO: 5, US20160375110A1 SEQ ID NO: 4 |
| rh74 (RHM15-1) | 1538 | US2015023924A1 SEQ ID NO: 6, US20160375110A1 SEQ ID NO: 5 |
| rh74 (RHM15-2) | 1539 | US2015023924A1 SEQ ID NO: 7, US20160375110A1 SEQ ID NO: 6 |
| rh74 (RHM15-3/RHM15-5) | 1540 | US2015023924A1 SEQ ID NO: 8, US20160375110A1 SEQ ID NO: 7 |
| rh74 (RHM15-4) | 1541 | US2015023924A1 SEQ ID NO: 9, US20160375110A1 SEQ ID NO: 8 |
| rh74 (RHM15-6) | 1542 | US2015023924A1 SEQ ID NO: 10, US20160375110A1 SEQ ID NO: 9 |
| rh74 (RHM4-1) | 1543 | US2015023924A1 SEQ ID NO: 11 |
| rh74 (RHM15-1) | 1544 | US2015023924A1 SEQ ID NO: 12 |
| rh74 (RHM15-2) | 1545 | US2015023924A1 SEQ ID NO: 13 |
| rh74 (RHM15-3/RHM15-5) | 1546 | US2015023924A1 SEQ ID NO: 14 |
| rh74 (RHM15-4) | 1547 | US2015023924A1 SEQ ID NO: 15 |
| rh74 (RHM15-6) | 1548 | US2015023924A1 SEQ ID NO: 16 |
| AAV2 (comprising lung specific polypeptide) | 1549 | US20160175389A1 SEQ ID NO: 9 |
| AAV2 (comprising lung specific polypeptide) | 1550 | US20160175389A1 SEQ ID NO: 10 |
| Anc80 | 1551 | US20170051257A1 SEQ ID NO: 1 |
| Anc80 | 1552 | US20170051257A1 SEQ ID NO: 2 |
| Anc81 | 1553 | US20170051257A1 SEQ ID NO: 3 |
| Anc80 | 1554 | US20170051257A1 SEQ ID NO: 4 |
| Anc82 | 1555 | US20170051257A1 SEQ ID NO: 5 |
| Anc82 | 1556 | US20170051257A1 SEQ ID NO: 6 |
| Anc83 | 1557 | US20170051257A1 SEQ ID NO: 7 |
| Anc83 | 1558 | US20170051257A1 SEQ ID NO: 8 |
| Anc84 | 1559 | US20170051257A1 SEQ ID NO: 9 |
| Anc84 | 1560 | US20170051257A1 SEQ ID NO: 10 |
| Anc94 | 1561 | US20170051257A1 SEQ ID NO: 11 |
| Anc94 | 1562 | US20170051257A1 SEQ ID NO: 12 |
| Anc113 | 1563 | US20170051257A1 SEQ ID NO: 13 |
| Anc113 | 1564 | US20170051257A1 SEQ ID NO: 14 |
| Anc126 | 1565 | US20170051257A1 SEQ ID NO: 15 |
| Anc126 | 1566 | US20170051257A1 SEQ ID NO: 16 |
| Anc127 | 1567 | US20170051257A1 SEQ ID NO: 17 |
| Anc127 | 1568 | US20170051257A1 SEQ ID NO: 18 |
| Anc80L27 | 1569 | US20170051257A1 SEQ ID NO: 19 |
| Anc80L59 | 1570 | US20170051257A1 SEQ ID NO: 20 |
| Anc80L60 | 1571 | US20170051257A1 SEQ ID NO: 21 |
| Anc80L62 | 1572 | US20170051257A1 SEQ ID NO: 22 |
| Anc80L65 | 1573 | US20170051257A1 SEQ ID NO: 23 |
| Anc80L33 | 1574 | US20170051257A1 SEQ ID NO: 24 |
| Anc80L36 | 1575 | US20170051257A1 SEQ ID NO: 25 |
| Anc80L44 | 1576 | US20170051257A1 SEQ ID NO: 26 |
| Anc80L1 | 1577 | US20170051257A1 SEQ ID NO: 35 |
| Anc80L1 | 1578 | US20170051257A1 SEQ ID NO: 36 |
| AAV-X1 | 1579 | US8283151B2 SEQ ID NO: 11 |
| AAV-X1b | 1580 | US8283151B2 SEQ ID NO: 12 |
| AAV-X5 | 1581 | US8283151B2 SEQ ID NO: 13 |
| AAV-X19 | 1582 | US8283151B2 SEQ ID NO: 14 |
| AAV-X21 | 1583 | US8283151B2 SEQ ID NO: 15 |
| AAV-X22 | 1584 | US8283151B2 SEQ ID NO: 16 |
| AAV-X23 | 1585 | US8283151B2 SEQ ID NO: 17 |
| AAV-X24 | 1586 | US8283151B2 SEQ ID NO: 18 |
| AAV-X25 | 1587 | US8283151B2 SEQ ID NO: 19 |
| AAV-X26 | 1588 | US8283151B2 SEQ ID NO: 20 |
| AAV-X1 | 1589 | US8283151B2 SEQ ID NO: 21 |
| AAV-X1b | 1590 | US8283151B2 SEQ ID NO: 22 |
| AAV-X5 | 1591 | US8283151B2 SEQ ID NO: 23 |
| AAV-X19 | 1592 | US8283151B2 SEQ ID NO: 24 |
| AAV-X21 | 1593 | US8283151B2 SEQ ID NO: 25 |
| AAV-X22 | 1594 | US8283151B2 SEQ ID NO: 26 |
| AAV-X23 | 1595 | US8283151B2 SEQ ID NO: 27 |
| AAV-X24 | 1596 | US8283151B2 SEQ ID NO: 28 |
| AAV-X25 | 1597 | US8283151B2 SEQ ID NO: 29 |
| AAV-X26 | 1598 | US8283151B2 SEQ ID NO: 30 |
| AAVrh8 | 1599 | WO2016054554A1 SEQ ID NO: 8 |
| AAVrh8VP2 FCS | 1600 | WO2016054554A1 SEQ ID NO: 9 |
| AAVrh8VP2 FC44 | 1601 | WO2016054554A1 SEQ ID NO: 10 |
| AAVrh8VP2 ApoB100 | 1602 | WO2016054554A1 SEQ ID NO: 11 |
| AAVrh8VP2 RVG | 1603 | WO2016054554A1 SEQ ID NO: 12 |
| AAVrh8VP2 Angiopep-2 VP2 | 1604 | WO2016054554A1 SEQ ID NO: 13 |
| AAV9.47VP1.3 | 1605 | WO2016054554A1 SEQ ID NO: 14 |
| AAV9.47VP2ICAMg3 | 1606 | WO2016054554A1 SEQ ID NO: 15 |
| AAV9.47VP2RVG | 1607 | WO2016054554A1 SEQ ID NO: 16 |
| AAV9.47VP2Angiopep-2 | 1608 | WO2016054554A1 SEQ ID NO: 17 |
| AAV9.47VP2A-string | 1609 | WO2016054554A1 SEQ ID NO: 18 |
| AAVrh8VP2 FC5 VP2 | 1610 | WO2016054554A1 SEQ ID NO: 19 |
| AAVrh8VP2 FC44 VP2 | 1611 | WO2016054554A1 SEQ ID NO: 20 |
| AAVrh8VP2 ApoB100 VP2 | 1612 | WO2016054554A1 SEQ ID NO: 21 |
| AAVrh8VP2 RVG VP2 | 1613 | WO2016054554A1 SEQ ID NO: 22 |
| AAVrh8VP2 Angiopep-2 VP2 | 1614 | WO2016054554A1 SEQ ID NO: 23 |
| AAV9.47VP2ICAMg3 VP2 | 1615 | WO2016054554A1 SEQ ID NO: 24 |
| AAV9.47VP2RVG VP2 | 1616 | WO2016054554A1 SEQ ID NO: 25 |
| AAV9.47VP2Angiopep-2 VP2 | 1617 | WO2016054554A1 SEQ ID NO: 26 |
| AAV9.47VP2A-string VP2 | 1618 | WO2016054554A1 SEQ ID NO: 27 |
| rAAV-B1 | 1619 | WO2016054557A1 SEQ ID NO: 1 |
| rAAV-B2 | 1620 | WO2016054557A1 SEQ ID NO: 2 |
| rAAV-B3 | 1621 | WO2016054557A1 SEQ ID NO: 3 |
| rAAV-B4 | 1622 | WO2016054557A1 SEQ ID NO: 4 |
| rAAV-B1 | 1623 | WO2016054557A1 SEQ ID NO: 5 |
| rAAV-B2 | 1624 | WO2016054557A1 SEQ ID NO: 6 |
| rAAV-B3 | 1625 | WO2016054557A1 SEQ ID NO: 7 |
| rAAV-B4 | 1626 | WO2016054557A1 SEQ ID NO: 8 |
| rAAV-L1 | 1627 | WO2016054557A1 SEQ ID NO: 9 |
| rAAV-L2 | 1628 | WO2016054557A1 SEQ ID NO: 10 |
| rAAV-L3 | 1629 | WO2016054557A1 SEQ ID NO: 11 |
| rAAV-L4 | 1630 | WO2016054557A1 SEQ ID NO: 12 |
| rAAV-L1 | 1631 | WO2016054557A1 SEQ ID NO: 13 |
| rAAV-L2 | 1632 | WO2016054557A1 SEQ ID NO: 14 |

TABLE 1-continued

AAV Serotypes

| Serotype | SEQ ID NO | Reference Information |
|---|---|---|
| rAAV-L3 | 1633 | WO2016054557A1 SEQ ID NO: 15 |
| rAAV-L4 | 1634 | WO2016054557A1 SEQ ID NO: 16 |
| AAV9 | 1635 | WO2016073739A1 SEQ ID NO: 3 |
| rAAV | 1636 | WO2016081811A1 SEQ ID NO: 1 |
| rAAV | 1637 | WO2016081811A1 SEQ ID NO: 2 |
| rAAV | 1638 | WO2016081811A1 SEQ ID NO: 3 |
| rAAV | 1639 | WO2016081811A1 SEQ ID NO: 4 |
| rAAV | 1640 | WO2016081811A1 SEQ ID NO: 5 |
| rAAV | 1641 | WO2016081811A1 SEQ ID NO: 6 |
| rAAV | 1642 | WO2016081811A1 SEQ ID NO: 7 |
| rAAV | 1643 | WO2016081811A1 SEQ ID NO: 8 |
| rAAV | 1644 | WO2016081811A1 SEQ ID NO: 9 |
| rAAV | 1645 | WO2016081811A1 SEQ ID NO: 10 |
| rAAV | 1646 | WO2016081811A1 SEQ ID NO: 11 |
| rAAV | 1647 | WO2016081811A1 SEQ ID NO: 12 |
| rAAV | 1648 | WO2016081811A1 SEQ ID NO: 13 |
| rAAV | 1649 | WO2016081811A1 SEQ ID NO: 14 |
| rAAV | 1650 | WO2016081811A1 SEQ ID NO: 15 |
| rAAV | 1651 | WO2016081811A1 SEQ ID NO: 16 |
| rAAV | 1652 | WO2016081811A1 SEQ ID NO: 17 |
| rAAV | 1653 | WO2016081811A1 SEQ ID NO: 18 |
| rAAV | 1654 | WO2016081811A1 SEQ ID NO: 19 |
| rAAV | 1655 | WO2016081811A1 SEQ ID NO: 20 |
| rAAV | 1656 | WO2016081811A1 SEQ ID NO: 21 |
| rAAV | 1657 | WO2016081811A1 SEQ ID NO: 22 |
| rAAV | 1658 | WO2016081811A1 SEQ ID NO: 23 |
| rAAV | 1659 | WO2016081811A1 SEQ ID NO: 24 |
| rAAV | 1660 | WO2016081811A1 SEQ ID NO: 25 |
| rAAV | 1661 | WO2016081811A1 SEQ ID NO: 26 |
| rAAV | 1662 | WO2016081811A1 SEQ ID NO: 27 |
| rAAV | 1663 | WO2016081811A1 SEQ ID NO: 28 |
| rAAV | 1664 | WO2016081811A1 SEQ ID NO: 29 |
| rAAV | 1665 | WO2016081811A1 SEQ ID NO: 30 |
| rAAV | 1666 | WO2016081811A1 SEQ ID NO: 31 |
| rAAV | 1667 | WO2016081811A1 SEQ ID NO: 32 |
| rAAV | 1668 | WO2016081811A1 SEQ ID NO: 33 |
| rAAV | 1669 | WO2016081811A1 SEQ ID NO: 34 |
| rAAV | 1670 | WO2016081811A1 SEQ ID NO: 35 |
| rAAV | 1671 | WO2016081811A1 SEQ ID NO: 36 |
| rAAV | 1672 | WO2016081811A1 SEQ ID NO: 37 |
| rAAV | 1673 | WO2016081811A1 SEQ ID NO: 38 |
| rAAV | 1674 | WO2016081811A1 SEQ ID NO: 39 |
| rAAV | 1675 | WO2016081811A1 SEQ ID NO: 40 |
| rAAV | 1676 | WO2016081811A1 SEQ ID NO: 41 |
| rAAV | 1677 | WO2016081811A1 SEQ ID NO: 42 |
| rAAV | 1678 | WO2016081811A1 SEQ ID NO: 43 |
| rAAV | 1679 | WO2016081811A1 SEQ ID NO: 44 |
| rAAV | 1680 | WO2016081811A1 SEQ ID NO: 45 |
| rAAV | 1681 | WO2016081811A1 SEQ ID NO: 46 |
| rAAV | 1682 | WO2016081811A1 SEQ ID NO: 47 |
| rAAV | 1683 | WO2016081811A1 SEQ ID NO: 48 |
| rAAV | 1684 | WO2016081811A1 SEQ ID NO: 49 |
| rAAV | 1685 | WO2016081811A1 SEQ ID NO: 50 |
| rAAV | 1686 | WO2016081811A1 SEQ ID NO: 51 |
| rAAV | 1687 | WO2016081811A1 SEQ ID NO: 52 |
| rAAV | 1688 | WO2016081811A1 SEQ ID NO: 53 |
| rAAV | 1689 | WO2016081811A1 SEQ ID NO: 54 |
| rAAV | 1690 | WO2016081811A1 SEQ ID NO: 55 |
| rAAV | 1691 | WO2016081811A1 SEQ ID NO: 56 |
| rAAV | 1692 | WO2016081811A1 SEQ ID NO: 57 |
| rAAV | 1693 | WO2016081811A1 SEQ ID NO: 58 |
| rAAV | 1694 | WO2016081811A1 SEQ ID NO: 59 |
| rAAV | 1695 | WO2016081811A1 SEQ ID NO: 60 |
| rAAV | 1696 | WO2016081811A1 SEQ ID NO: 61 |
| rAAV | 1697 | WO2016081811A1 SEQ ID NO: 62 |
| rAAV | 1698 | WO2016081811A1 SEQ ID NO: 63 |
| rAAV | 1699 | WO2016081811A1 SEQ ID NO: 64 |
| rAAV | 1700 | WO2016081811A1 SEQ ID NO: 65 |
| rAAV | 1701 | WO2016081811A1 SEQ ID NO: 66 |
| rAAV | 1702 | WO2016081811A1 SEQ ID NO: 67 |
| rAAV | 1703 | WO2016081811A1 SEQ ID NO: 68 |
| rAAV | 1704 | WO2016081811A1 SEQ ID NO: 69 |
| rAAV | 1705 | WO2016081811A1 SEQ ID NO: 70 |
| rAAV | 1706 | WO2016081811A1 SEQ ID NO: 71 |
| rAAV | 1707 | WO2016081811A1 SEQ ID NO: 72 |
| rAAV | 1708 | WO2016081811A1 SEQ ID NO: 73 |
| rAAV | 1709 | WO2016081811A1 SEQ ID NO: 74 |
| rAAV | 1710 | WO2016081811A1 SEQ ID NO: 75 |
| rAAV | 1711 | WO2016081811A1 SEQ ID NO: 76 |
| rAAV | 1712 | WO2016081811A1 SEQ ID NO: 77 |
| rAAV | 1713 | WO2016081811A1 SEQ ID NO: 78 |
| rAAV | 1714 | WO2016081811A1 SEQ ID NO: 79 |
| rAAV | 1715 | WO2016081811A1 SEQ ID NO: 80 |
| rAAV | 1716 | WO2016081811A1 SEQ ID NO: 81 |
| rAAV | 1717 | WO2016081811A1 SEQ ID NO: 82 |
| rAAV | 1718 | WO2016081811A1 SEQ ID NO: 83 |
| rAAV | 1719 | WO2016081811A1 SEQ ID NO: 84 |
| rAAV | 1720 | WO2016081811A1 SEQ ID NO: 85 |
| rAAV | 1721 | WO2016081811A1 SEQ ID NO: 86 |
| rAAV | 1722 | WO2016081811A1 SEQ ID NO: 87 |
| rAAV | 1723 | WO2016081811A1 SEQ ID NO: 88 |
| rAAV | 1724 | WO2016081811A1 SEQ ID NO: 89 |
| rAAV | 1725 | WO2016081811A1 SEQ ID NO: 90 |
| rAAV | 1726 | WO2016081811A1 SEQ ID NO: 91 |
| rAAV | 1727 | WO2016081811A1 SEQ ID NO: 92 |
| rAAV | 1728 | WO2016081811A1 SEQ ID NO: 93 |
| rAAV | 1729 | WO2016081811A1 SEQ ID NO: 94 |
| rAAV | 1730 | WO2016081811A1 SEQ ID NO: 95 |
| rAAV | 1731 | WO2016081811A1 SEQ ID NO: 96 |
| rAAV | 1732 | WO2016081811A1 SEQ ID NO: 97 |
| rAAV | 1733 | WO2016081811A1 SEQ ID NO: 98 |
| rAAV | 1734 | WO2016081811A1 SEQ ID NO: 99 |
| rAAV | 1735 | WO2016081811A1 SEQ ID NO: 100 |
| rAAV | 1736 | WO2016081811A1 SEQ ID NO: 101 |
| rAAV | 1737 | WO2016081811A1 SEQ ID NO: 102 |
| rAAV | 1738 | WO2016081811A1 SEQ ID NO: 103 |
| rAAV | 1739 | WO2016081811A1 SEQ ID NO: 104 |
| rAAV | 1740 | WO2016081811A1 SEQ ID NO: 105 |
| rAAV | 1741 | WO2016081811A1 SEQ ID NO: 106 |
| rAAV | 1742 | WO2016081811A1 SEQ ID NO: 107 |
| rAAV | 1743 | WO2016081811A1 SEQ ID NO: 108 |
| rAAV | 1744 | WO2016081811A1 SEQ ID NO: 109 |
| rAAV | 1745 | WO2016081811A1 SEQ ID NO: 110 |
| rAAV | 1746 | WO2016081811A1 SEQ ID NO: 111 |
| rAAV | 1747 | WO2016081811A1 SEQ ID NO: 112 |
| rAAV | 1748 | WO2016081811A1 SEQ ID NO: 113 |
| rAAV | 1749 | WO2016081811A1 SEQ ID NO: 114 |
| rAAV | 1750 | WO2016081811A1 SEQ ID NO: 115 |
| rAAV | 1751 | WO2016081811A1 SEQ ID NO: 116 |
| rAAV | 1752 | WO2016081811A1 SEQ ID NO: 117 |
| rAAV | 1753 | WO2016081811A1 SEQ ID NO: 118 |
| rAAV | 1754 | WO2016081811A1 SEQ ID NO: 119 |
| rAAV | 1755 | WO2016081811A1 SEQ ID NO: 120 |
| rAAV | 1756 | WO2016081811A1 SEQ ID NO: 121 |
| rAAV | 1757 | WO2016081811A1 SEQ ID NO: 122 |
| rAAV | 1758 | WO2016081811A1 SEQ ID NO: 123 |
| rAAV | 1759 | WO2016081811A1 SEQ ID NO: 124 |
| rAAV | 1760 | WO2016081811A1 SEQ ID NO: 125 |
| rAAV | 1761 | WO2016081811A1 SEQ ID NO: 126 |
| rAAV | 1762 | WO2016081811A1 SEQ ID NO: 127 |
| rAAV | 1763 | WO2016081811A1 SEQ ID NO: 128 |
| AAV8 E532K | 1764 | WO2016081811A1 SEQ ID NO: 133 |
| AAV8 E532K | 1765 | WO2016081811A1 SEQ ID NO: 134 |
| rAAV4 | 1766 | WO2016115382A1 SEQ ID NO: 2 |
| rAAV4 | 1767 | WO2016115382A1 SEQ ID NO: 3 |
| rAAV4 | 1768 | WO2016115382A1 SEQ ID NO: 4 |
| rAAV4 | 1769 | WO2016115382A1 SEQ ID NO: 5 |
| rAAV4 | 1770 | WO2016115382A1 SEQ ID NO: 6 |
| rAAV4 | 1771 | WO2016115382A1 SEQ ID NO: 7 |
| rAAV4 | 1772 | WO2016115382A1 SEQ ID NO: 8 |
| rAAV4 | 1773 | WO2016115382A1 SEQ ID NO: 9 |
| rAAV4 | 1774 | WO2016115382A1 SEQ ID NO: 10 |
| rAAV4 | 1775 | WO2016115382A1 SEQ ID NO: 11 |
| rAAV4 | 1776 | WO2016115382A1 SEQ ID NO: 12 |
| rAAV4 | 1777 | WO2016115382A1 SEQ ID NO: 13 |
| rAAV4 | 1778 | WO2016115382A1 SEQ ID NO: 14 |

TABLE 1-continued

AAV Serotypes

| Serotype | SEQ ID NO | Reference Information |
|---|---|---|
| rAAV4 | 1779 | WO2016115382A1 SEQ ID NO: 15 |
| rAAV4 | 1780 | WO2016115382A1 SEQ ID NO: 16 |
| rAAV4 | 1781 | WO2016115382A1 SEQ ID NO: 17 |
| rAAV4 | 1782 | WO2016115382A1 SEQ ID NO: 18 |
| rAAV4 | 1783 | WO2016115382A1 SEQ ID NO: 19 |
| rAAV4 | 1784 | WO2016115382A1 SEQ ID NO: 20 |
| rAAV4 | 1785 | WO2016115382A1 SEQ ID NO: 21 |
| AAV11 | 1786 | WO2016115382A1 SEQ ID NO: 22 |
| AAV12 | 1787 | WO2016115382A1 SEQ ID NO: 23 |
| rh32 | 1788 | WO2016115382A1 SEQ ID NO: 25 |
| rh33 | 1789 | WO2016115382A1 SEQ ID NO: 26 |
| rh34 | 1790 | WO2016115382A1 SEQ ID NO: 27 |
| rAAV4 | 1791 | WO2016115382A1 SEQ ID NO: 28 |
| rAAV4 | 1792 | WO2016115382A1 SEQ ID NO: 29 |
| rAAV4 | 1793 | WO2016115382A1 SEQ ID NO: 30 |
| rAAV4 | 1794 | WO2016115382A1 SEQ ID NO: 31 |
| rAAV4 | 1795 | WO2016115382A1 SEQ ID NO: 32 |
| rAAV4 | 1796 | WO2016115382A1 SEQ ID NO: 33 |
| AAV2/8 | 1797 | WO2016115382A1 SEQ ID NO: 47 |
| AAV2/8 | 1798 | WO2016115382A1 SEQ ID NO: 48 |
| ancestral AAV | 1799 | WO2016154344A1 SEQ ID NO: 7 |
| ancestral AAV variant C4 | 1800 | WO2016154344A1 SEQ ID NO: 13 |
| ancestral AAV variant C7 | 1801 | WO2016154344A1 SEQ ID NO: 14 |
| ancestral AAV variant G4 | 1802 | WO2016154344A1 SEQ ID NO: 15 |
| consensus amino acid sequence of ancestral AAV variants, C4, C7 and G4 | 1803 | WO2016154344A1 SEQ ID NO: 16 |
| consensus amino acid sequence of ancestral AAV variants, C4 and C7 | 1804 | WO2016154344A1 SEQ ID NO: 17 |
| AAV8 (with a AAV2 phospholipase domain) | 1805 | WO2016150403A1 SEQ ID NO: 13 |
| AAV VR-942n | 1806 | US20160289275A1 SEQ ID NO: 10 |
| AAV5-A (M569V) | 1807 | US20160289275A1 SEQ ID NO: 13 |
| AAV5-A (M569V) | 1808 | US20160289275A1 SEQ ID NO: 14 |
| AAV5-A (Y585V) | 1809 | US20160289275A1 SEQ ID NO: 16 |
| AAV5-A (Y585V) | 1810 | US20160289275A1 SEQ ID NO: 17 |
| AAV5-A (L587T) | 1811 | US20160289275A1 SEQ ID NO: 19 |
| AAV5-A (L587T) | 1812 | US20160289275A1 SEQ ID NO: 20 |
| AAV5-A (Y585V/L587T) | 1813 | US20160289275A1 SEQ ID NO: 22 |
| AAV5-A (Y585V/L587T) | 1814 | US20160289275A1 SEQ ID NO: 23 |
| AAV5-B (D652.A) | 1815 | US20160289275A1 SEQ ID NO: 25 |
| AAV5-B (D652A) | 1816 | US20160289275A1 SEQ ID NO: 26 |
| AAV5-B (T362M) | 1817 | US20160289275A1 SEQ ID NO: 28 |
| AAV5-B (T362M) | 1818 | US20160289275A1 SEQ ID NO: 29 |
| AAV5-B (Q359D) | 1819 | US20160289275A1 SEQ ID NO: 31 |
| AAV5-B (Q359D) | 1820 | US20160289275A1 SEQ ID NO: 32 |
| AAV5-B (E350Q) | 1821 | US20160289275A1 SEQ ID NO: 34 |
| AAV5-B (E350Q) | 1822 | US20160289275A1 SEQ ID NO: 35 |
| AAV5-B (P533S) | 1823 | US20160289275A1 SEQ ID NO: 37 |
| AAV5-B (P533S) | 1824 | US20160289275A1 SEQ ID NO: 38 |
| AAV5-B (P533G) | 1825 | US20160289275A1 SEQ ID NO: 40 |
| AAV5-B (P533G) | 1826 | US20160289275A1 SEQ ID NO: 41 |
| AAV5-mutation in loop VII | 1827 | US20160289275A1 SEQ ID NO: 43 |
| AAV5-mutation in loop VII | 1828 | US20160289275A1 SEQ ID NO: 44 |
| AAV8 | 1829 | US20160289275A1 SEQ ID NO: 47 |
| Mut A (LK03/AAV8) | 1830 | WO2016181123A1 SEQ ID NO: 1 |
| Mut B (LK03/AAV5) | 1831 | WO2016181123A1 SEQ ID NO: 2 |
| Mut C (AAV8/AAV3B) | 1832 | WO2016181123A1 SEQ ID NO: 3 |
| Mut D (AAV5/AAV3E) | 1833 | WO2016181123A1 SEQ ID NO: 4 |
| Mut E (AAV8/AAV3B) | 1834 | WO2016181123A1 SEQ ID NO: 5 |
| Mut F (AAV3B/AAV8) | 1835 | WO2016181123A1 SEQ ID NO: 6 |
| AAV44.9 | 1836 | WO2016183297A1 SEQ ID NO: 4 |
| AAV44.9 | 1837 | WO2016183297A1 SEQ ID NO: 5 |
| AAVrh8 | 1838 | WO2016183297A1 SEQ ID NO: 6 |
| AAV44.9 (S470N) | 1839 | WO2016183297A1 SEQ ID NO: 9 |
| rh74 VP1 | 1840 | US20160375110A1 SEQ ID NO: 1 |
| AAV-LK03 (L125I) | 1841 | WO2017015102A1 SEQ ID NO: 5 |
| AAV3B (S663V + T492V) | 1842 | WO2017015102A1 SEQ ID NO: 6 |
| Anc80 | 1843 | WO2017019994A2 SEQ ID NO: 1 |
| Anc80 | 1844 | WO2017019994A2 SEQ ID NO: 2 |
| Anc81 | 1845 | WO2017019994A2 SEQ ID NO: 3 |
| Anc81 | 1846 | WO2017019994A2 SEQ ID NO: 4 |
| Anc82 | 1847 | WO2017019994A2 SEQ ID NO: 5 |
| Anc82 | 1848 | WO2017019994A2 SEQ ID NO: 6 |
| Anc83 | 1849 | WO2017019994A2 SEQ ID NO: 7 |
| Anc83 | 1850 | WO2017019994A2 SEQ ID NO: 8 |
| Anc84 | 1851 | WO2017019994A2 SEQ ID NO: 9 |
| Anc84 | 1852 | WO2017019994A2 SEQ ID NO: 10 |
| Anc94 | 1853 | WO2017019994A2 SEQ ID NO: 11 |
| Anc94 | 1854 | WO2017019994A2 SEQ ID NO: 12 |
| Anc113 | 1855 | WO2017019994A2 SEQ ID NO: 13 |
| Anc113 | 1856 | WO2017019994A2 SEQ ID NO: 14 |
| Anc126 | 1857 | WO2017019994A2 SEQ ID NO: 15 |
| Anc126 | 1858 | WO2017019994A2 SEQ ID NO: 16 |
| Anc127 | 1859 | WO2017019994A2 SEQ ID NO: 17 |
| Anc127 | 1860 | WO2017019994A2 SEQ ID NO: 18 |
| Anc80L27 | 1861 | WO2017019994A2 SEQ ID NO: 19 |
| Anc80L59 | 1862 | WO2017019994A2 SEQ ID NO: 20 |

TABLE 1-continued

AAV Serotypes

| Serotype | SEQ ID NO | Reference Information |
|---|---|---|
| Anc80L60 | 1863 | WO2017019994A2 SEQ ID NO: 21 |
| Anc80L62 | 1864 | WO2017019994A2 SEQ ID NO: 22 |
| Anc80L65 | 1865 | WO2017019994A2 SEQ ID NO: 23 |
| Anc80L33 | 1866 | WO2017019994A2 SEQ ID NO: 24 |
| Anc80L36 | 1867 | WO2017019994A2 SEQ ID NO: 25 |
| Am80L44 | 1868 | WO2017019994A2 SEQ ID NO: 26 |
| Anc80L1 | 1869 | WO2017019994A2 SEQ ID NO: 35 |
| Anc80LI | 1870 | WO2017019994A2 SEQ ID NO: 36 |
| AAVrh10 | 1871 | WO2017019994A2 SEQ ID NO: 41 |
| Anc110 | 1872 | WO2017019994A2 SEQ ID NO: 42 |
| Anc110 | 1873 | WO2017019994A2 SEQ ID NO: 43 |
| AAVrh32.33 | 1874 | WO2017019994A2 SEQ ID NO: 45 |
| AAVrh74 | 1875 | WO2017049031A1 SEQ ID NO: 1 |
| AAV2 | 1876 | WO2017053629A2 SEQ ID NO: 49 |
| AAV2 | 1877 | WO2017053629A2 SEQ ID NO: 50 |
| AAV2 | 1878 | WO2017053629A2 SEQ ID NO: 82 |
| Parvo-like virus | 1879 | WO2017070476A2 SEQ ID NO: 1 |
| Parvo-like virus | 1880 | WO2017070476A2 SEQ ID NO: 2 |
| Parvo-like virus | 1881 | WO2017070476A2 SEQ ID NO: 3 |
| Parvo-like virus | 1882 | WO2017070476A2 SEQ ID NO: 4 |
| Parvo-like virus | 1883 | WO2017070476A2 SEQ ID NO: 5 |
| Parvo-like vints | 1884 | WO2017070476A2 SEQ ID NO: 6 |
| AAVrh.10 | 1885 | WO2017070516A1 SEQ ID NO: 7 |
| AAVrh.10 | 1886 | WO2017070516A1 SEQ ID NO: 14 |
| AAV2tYF | 1887 | WO2017070491A1 SEQ ID NO: 1 |
| AAV-SPK | 1888 | WO2017075619A1 SEQ ID NO: 28 |
| AAV2.5 | 1889 | US20170128528A1 SEQ ID NO: 13 |
| AAV1.1 | 1890 | US20170128528A1 SEQ ID NO: 15 |
| AAV6.1 | 1891 | US20170128528A1 SEQ ID NO: 17 |
| AAV6.3.1 | 1892 | US20170128528A1 SEQ ID NO: 18 |
| AAV2i8 | 1893 | US20170128528A1 SEQ ID NO: 28 |
| AAV2i8 | 1894 | US20170128528A1 SEQ ID NO: 29 |
| ttAAV | 1895 | US20170128528A1 SEQ ID NO: 30 |
| ttAAV-S312N | 1896 | U820170128528A1 SEQ ID NO: 32 |
| ttAAV-S312N | 1897 | US20170128528A1 SEQ ID NO: 33 |
| AAV6 (Y705, Y731, and T492) | 1898 | WO2016134337A1 SEQ ID NO: 24 |
| AAV2 | 1899 | WO2016134375A1 SEQ ID NO: 9 |
| AAV2 | 1900 | WO2016134375A1 SEQ ID NO: 10 |

Each of the patents, applications and/or publications listed in Table 1 are hereby incorporated by reference in their entirety.

In one embodiment, the AAV serotype may be, or may have a sequence as described in International Patent Publication WO2015038958, the contents of which are herein incorporated by reference in their entirety, such as, but not limited to, AAV9 (SEQ ID NO: 2 and 11 of WO2015038958 or SEQ ID NO: 127 and 126 respectively herein), PHP.B (SEQ ID NO: 8 and 9 of WO2015038958, herein SEQ ID NO: 868 and 869). G2B-13 (SEQ ID NO: 12 of WO2015038958, herein SEQ ID NO: 870), G2B-26 (SEQ ID NO: 13 of WO2015038958, herein SEQ ID NO: 868 and 869), TH1.1-32 (SEQ ID NO: 14 of WO2015038958, herein SEQ ID NO: 871), TH1.1-35 (SEQ ID NO: 15 of WO2015038958, herein SEQ ID NO: 872) or variants thereof. Further, any of the targeting peptides or amino acid inserts described in WO2015038958, may be inserted into any parent AAV serotype, such as, but not limited to, AAV9 (SEQ ID NO: 126 for the DNA sequence and SEQ ID NO: 127 for the amino acid sequence). In one embodiment, the amino acid insert is inserted between amino acids 586-592 of the parent AAV (e.g., AAV9). In another embodiment, the amino acid insert is inserted between amino acids 588-589 of the parent AAV sequence. The amino acid insert may be, but is not limited to, any of the following amino acid sequences, TLAVPFK (SEQ ID NO: 1 of WO2015038958; herein SEQ ID NO: 873), KFPVALT (SEQ ID NO: 3 of WO2015038958; herein SEQ ID NO: 874), LAVPFK (SEQ ID NO: 31 of WO2015038958; herein SEQ ID NO: 875), AVPFK (SEQ ID NO: 32 of WO2015038958; herein SEQ ID NO: 876), VPFK (SEQ ID NO: 33 of WO2015038958; herein SEQ ID NO: 877), TLAVPF (SEQ ID NO: 34 of WO2015038958; herein SEQ ID NO: 878), TLAVP (SEQ ID NO: 35 of WO2015038958; herein SEQ ID NO: 879), TLAV (SEQ ID NO: 36 of WO2015038958; herein SEQ ID NO: 880), SVSKPFL (SEQ ID NO: 28 of WO2015038958; herein SEQ ID NO: 881), FTLTTPK (SEQ ID NO: 29 of WO2015038958; herein SEQ ID NO: 882), MNATKNV (SEQ ID NO: 30 of WO02015038958; herein SEQ ID NO: 883), QSSQTPR (SEQ ID NO: 54 of WO2015038958; herein SEQ ID NO: 884), ILGTGTS (SEQ ID NO: 55 of WO2015038958, herein SEQ ID NO: 885), TRTNPEA (SEQ ID NO: 56 of WO2015038958; herein SEQ ID NO: 886), NGGTSSS (SEQ ID NO: 58 of WO2015038958; herein SEQ ID NO: 887), or YTLSQGW (SEQ ID NO: 60 of WO2015038958; herein SEQ ID NO: 888). Non-limiting examples of nucleotide sequences that may encode the amino acid inserts include the following, AAGTTTCCTGTGGCGTTGACT (for SEQ ID NO: 3 of WO2015038958; herein SEQ ID NO: 889), ACTTTGGCGGTGCCTTTTAAG (SEQ ID NO: 24 and 49 of WO2015038958; herein SEQ ID NO: 890), AGTGTGAGTAAGCCTTTTG (SEQ ID NO: 25 of WO2015038958; herein SEQ ID NO: 891), TTTACGTTGACGACGCCTAAG (SEQ ID NO: 26 of WO2015038958; herein SEQ ID NO: 892), ATGAATGCTACGAAGAATGTG (SEQ ID NO: 27 of WO2015038958; herein SEQ ID NO: 893), CAGTCGTCGCAGACGCCTAGG (SEQ ID NO: 48 of WO2015038958; herein SEQ ID NO: 894), ATTCTGGGGACTGGTACTTCG (SEQ ID NO: 50 and 52 of WO2015038958; herein SEQ ID NO: 895), ACGCGGACTAATCCTGAGGCT (SEQ ID NO: 51 of WO2015038958; herein SEQ ID NO: 896), AATGGGGGGACTAGTAGTTCT (SEQ ID NO: 53 of WO2015038958; herein SEQ ID NO: 897), or TATACTTTGTCGCAGGGTGG (SEQ ID NO: 59 of WO2015038958; herein SEQ ID NO: 898).

In one embodiment, the AAV serotype may be engineered to comprise at least one AAV capsid CD8+ T-cell epitope for AAV2 such as, but not limited to, SADNNNSEY (SEQ ID NO: 899), LIDQYLYYL (SEQ ID NO: 900), VPQYGYLTL (SEQ ID NO: 901), TTSTRTWAL (SEQ ID NO: 902), YHLNGRDSL (SEQ ID NO: 903), SQAVGRSSF (SEQ ID NO: 904), VPANPSTTF (SEQ ID NO: 905), FPQSGVLIF (SEQ ID NO: 906), YFDFNRFHCHFSPRD (SEQ ID NO: 907), VGNSSGNWHCDSTWM (SEQ ID NO: 908), QFSQAGASDIRDQSR (SEQ ID NO: 909), GASDIRQSRNWLP (SEQ ID NO: 910) and GNRQAATADVNTQGV (SEQ ID NO: 911).

In one embodiment, the AAV serotype may be engineered to comprise at least one AAV capsid CD8+ T-cell epitope for AAV1 such as, but not limited to, LDRLMNPLI (SEQ ID NO: 912), TTSTRTWAL (SEQ ID NO: 902), and QPAKKRLNF (SEQ ID NO: 913)).

In one embodiment, peptides for inclusion in an AAV serotype may be identified using the methods described by Hui et al. (Molecular Therapy—Methods & Clinical Development (2015) 2, 15029 doi:10.1038/mtm.2015.29; the contents of which are herein incorporated by reference in its entirety). As a non-limiting example, the procedure includes isolating human splenocytes, restimulating the splenocytes in vitro using individual peptides spanning the amino acid sequence of the AAV capsid protein, IFN-gamma ELISpot with the individual peptides used for the in vitro restimulation, bioinformatics analysis to determine the HLA restriction of 15-mers identified by IFN-gamma ELISpot, identification of candidate reactive 9-mer epitopes for a given HLA allele, synthesis candidate 9-mers, second IFN-gamma ELISpot screening of splenocytes from subjects carrying the HLA alleles to which identified AAV epitopes are predicted to bind, determine the AAV capsid-reactive CD8+ T cell epitopes and determine the frequency of subjects reacting to a given AAV epitope.

In one embodiment, the AAV may be a serotype generated by Cre-recombination-based AAV targeted evolution (CREATE) as described by Deverman et al., (Nature Biotechnology 34(2):204-209 (2016)), the contents of which are herein incorporated by reference in their entirety. In one embodiment, AAV serotypes generated in this manner have improved CNS transduction and/or neuronal and astrocytic tropism, as compared to other AAV serotypes. As non-limiting examples, the AAV serotype may be PHP.B, PHP.B2, PHP.B3, PHP.A, G2A12, G2A15. In one embodiment, these AAV serotypes may be AAV9 (SEQ ID NO: 126 and 127) derivatives with a 7-amino acid insert between amino acids 588-589. Non-limiting examples of these 7-amino acid inserts include TLAVPFK (SEQ ID NO: 873), SVSKPFL (SEQ ID NO: 1249), FTLTTPK (SEQ ID NO: 882), YTLSQGW (SEQ ID NO: 888), QAVRTSL (SEQ ID NO: 1176) and/or LAKERLS (SEQ ID NO: 1177).

In one embodiment, the AAV serotype may be, or may have a sequence as described in International Patent Publication WO2017100671, the contents of which are herein incorporated by reference in their entirety, such as, but not limited to, AAV9 (SEQ ID NO: 45 of WO2017100671, herein SEQ ID NO: 1441), PHP.N (SEQ ID NO: 46 of WO2017100671, herein SEQ ID NO: 1439), PHP.S (SEQ ID NO: 47 of WO2017100671, herein SEQ ID NO: 1440), or variants thereof. Further, any of the targeting peptides or amino acid inserts described in WO2017100671 may be inserted into any parent AAV serotype, such as, but not limited to, AAV9 (SEQ ID NO: 122 or SEQ ID NO: 1441). In one embodiment, the amino acid insert is inserted between amino acids 586-592 of the parent AAV (e.g., AAV9). In another embodiment, the amino acid insert is inserted between amino acids 588-589 of the parent AAV sequence. The amino acid insert may be, but is not limited to, any of the following amino acid sequences, AQTLAVPFKAQ (SEQ ID NO: 1 of WO2017100671; herein SEQ ID NO: 1442), AQSVSKPFLAQ (SEQ ID NO: 2 of WO2017100671; herein SEQ ID NO: 1443), AQFTLTTPKAQ (SEQ ID NO: 3 in the sequence listing of WO02017100671; herein SEQ ID NO: 1444), DGTLAVPFKAQ (SEQ ID NO: 4 in the sequence listing of WO2017100671; herein SEQ ID NO: 1445), ESTLAVPFKAQ (SEQ ID NO: 5 of WO2017100671; herein SEQ ID NO: 1446), GGTLAVPFKAQ (SEQ ID NO: 6 of WO2017100671; herein SEQ ID NO: 1447), AQTLATPFKAQ (SEQ ID NO: 7 and 33 of WO2017100671; herein SEQ ID NO: 1448), ATTTLATPFKAQ (SEQ ID NO: 8 of WO2017100671; herein SEQ ID NO: 1449), DGTLATPFKAQ (SEQ ID NO: 9 of WO2017100671; herein SEQ ID NO: 1450), GGTLATPFKAQ (SEQ ID NO: 10 of WO2017100671; herein SEQ ID NO: 1451), SGSLAVPFKAQ (SEQ ID NO: 11 of WO2017100671; herein SEQ ID NO: 1452), AQTLAQPFKAQ (SEQ ID NO: 12 of WO2017100671; herein SEQ ID NO: 1453), AQTLQQPFKAQ (SEQ ID NO: 13 of WO2017100671; herein SEQ ID NO: 1454), AQTLSNPFKAQ (SEQ ID NO: 14 of WO2017100671; herein SEQ ID NO: 1455), AQTLAVPFSNP (SEQ ID NO: 15 of WO2017100671; herein SEQ ID NO: 1456), QGTLAVPFKAQ (SEQ ID NO: 16 of WO2017100671; herein SEQ ID NO: 1457), NQTLAVPFKAQ (SEQ ID NO: 17 of WO2017100671; herein SEQ ID NO: 1458), EGSLAVPFKAQ (SEQ ID NO: 18 of WO2017100671; herein SEQ ID NO: 1459), SGNLAVPFKAQ (SEQ ID NO: 19 of WO2017100671; herein SEQ ID NO: 1460), EGTLAVPFKAQ (SEQ ID NO: 20 of WO2017100671; herein SEQ ID NO: 1461), DSTLAVPFKAQ (SEQ ID NO: 21 in Table 1 of WO2017100671; herein SEQ ID NO: 1462), AVTLAVPFKAQ (SEQ ID NO: 22 of WO2017100671; herein SEQ ID NO: 1463), AQTLSTPFKAQ (SEQ ID NO: 23 of WO2017100671; herein SEQ ID NO: 1464), AQTLPQPFKAQ (SEQ ID NO: 24 and 32 of WO2017100671; herein SEQ ID NO: 1465), AQTLSQPFKAQ (SEQ ID NO: 25 of WO2017100671; herein SEQ ID NO: 1466), AQTLQLPFKAQ (SEQ ID NO: 26 of WO2017100671; herein SEQ ID NO: 1467), AQTLTMPFKAQ (SEQ ID NO: 27, and 34 of WO2017100671 and SEQ ID NO: 35 in the sequence listing of WO2017100671; herein SEQ ID NO: 1468), AQTLTTPFKAQ (SEQ ID NO: 28 of WO2017100671; herein SEQ ID NO: 1469), AQYTLSQGWAQ (SEQ ID NO: 29 of WO2017100671; herein SEQ ID NO: 1470), AQMNATKNVAQ (SEQ ID NO: 30 of WO2017100671; herein SEQ ID NO: 1471), AQVSGGHHSAQ (SEQ ID NO: 31 of WO2017100671 herein SEQ ID NO: 1472), AQTLTAPFKAQ (SEQ ID NO: 35 in Table 1 of WO2017100671; herein SEQ ID NO: 1473), AQTLSKPFKAQ (SEQ ID NO: 36 of WO2017100671; herein SEQ ID NO: 1474), QAVRTSL (SEQ ID NO: 37 of WO2017100671; herein SEQ ID NO: 1475), YTLSQGW (SEQ ID NO: 38 of WO2017100671; herein SEQ ID NO: 888), LAKERLS (SEQ ID NO: 39 of WO2017100671; herein SEQ ID NO: 1476), TLAVPFK (SEQ ID NO: 40 in the sequence listing of WO2017100671; herein SEQ ID NO: 873), SVSKPFL (SEQ ID NO: 41 of WO2017100671; herein SEQ ID NO: 881), FTLTTPK (SEQ ID NO: 42 of WO2017100671; herein SEQ ID NO: 882), MNSTKNV (SEQ ID NO: 43 of WO2017100671; herein SEQ ID NO: 1477), VSGGHHS (SEQ ID NO: 44 of WO2017100671; herein SEQ ID NO: 1478), SAQTLAVPFKAQAQ (SEQ ID NO: 48 of WO2017100671; herein SEQ ID NO: 1479), SXXXLAVPFKAQAQ (SEQ ID NO: 49 of WO2017100671 wherein X may be any amino acid; herein SEQ ID NO: 1480), SAQXXXVPFKAQAQ (SEQ ID NO: 50 of WO2017100671 wherein X may be any amino acid; herein SEQ ID NO: 1481), SAQTLXXXFKAQAQ (SEQ ID NO: 51 of WO2017100671 wherein X may be any amino acid; herein SEQ ID NO: 1482), SAQTLAVXXXAQAQ (SEQ ID NO: 52 of WO2017100671 wherein X may be any amino acid; herein SEQ ID NO: 1483), SAQTLAVPFXXXAQ (SEQ ID NO: 53 of WO2017100671 wherein X may be any amino acid; herein SEQ ID NO: 1484), TNHQSAQ (SEQ ID NO: 65 of WO2017100671; herein SEQ ID NO: 1485), AQAQTGW (SEQ ID NO: 66 of WO02017100671; herein SEQ ID NO: 1486), DGT- LATPFK (SEQ ID NO: 67 of WO2017100671; herein SEQ ID NO: 1487), DGTLATPFKXX (SEQ ID NO: 68 of WO2017100671 wherein X may be any amino acid; herein SEQ ID NO: 1488), LAVPFKAQ (SEQ ID NO: 80 of WO2017100671; herein SEQ ID NO: 1489), VPFKAQ (SEQ ID NO: 81 of WO2017100671; herein SEQ ID NO: 1490), FKAQ (SEQ ID NO: 82 of WO2017100671; herein SEQ ID NO: 1491), AQTLAV (SEQ ID NO: 83 of WO2017100671; herein SEQ ID NO: 1492), AQTLAVPF (SEQ ID NO: 84 of WO2017100671; herein SEQ ID NO: 1493), QAVR (SEQ ID NO: 85 of WO2017100671; herein SEQ ID NO: 1494), AVRT (SEQ ID NO: 86 of WO2017100671; herein SEQ ID NO: 1495), VRTS (SEQ ID NO: 87 of WO2017100671; herein SEQ ID NO: 1496), RTSL (SEQ ID NO: 88 of WO2017100671; herein SEQ ID NO: 1497), QAVRT (SEQ ID NO: 89 of WO2017100671; herein SEQ ID NO: 1498), AVRTS (SEQ ID NO: 90 of WO2017100671; herein SEQ ID NO: 1499), VRTSL (SEQ ID NO: 91 of WO02017100671; herein SEQ ID NO: 1500), QAVRTS (SEQ ID NO: 92 of WO2017100671; herein SEQ ID NO: 1501), or AVRTSL (SEQ ID NO: 93 of WO2017100671; herein SEQ ID NO: 1502).

Non-limiting examples of nucleotide sequences that may encode the amino acid inserts include the following, GATGGGACTTTGGCGGTGCCTTTTAAGGCACAG (SEQ ID NO: 54 of WO2017100671; herein SEQ ID NO: 1503), GATGGGACGTTGGCGGTGCCTTT-TAAGGCACAG (SEQ ID NO: 55 of WO2017100671; herein SEQ ID NO: 1504), CAGGCGGT-TAGGACGTCTTTG (SEQ ID NO: 56 of WO2017100671; herein SEQ ID NO: 1505), CAGGTCTTCACGGACTCA-GACTATCAG (SEQ ID NO: 57 and 78 of WO2017100671; herein SEQ ID NO: 1506), CAAGTAAAACCTCTA-CAAATGTGGTAAAATCG (SEQ ID NO: 58 of WO2017100671; herein SEQ ID NO: 1507), ACT-CATCGACCAATACTTGTACTATCTCTAGAAC (SEQ ID NO: 59 of WO2017100671; herein SEQ ID NO: 1508), GGAAGTATTCCTTGGTTTTGAACCCA (SEQ ID NO: 60 of WO2017100671; herein SEQ ID NO: 1509), GGTCGCGGTTCTTTGTTGTGGAT (SEQ ID NO: 61 of WO2017100671; herein SEQ ID NO: 1510), CGACCTT-GAAGCGCATGAACTCCT (SEQ ID NO: 62 of WO2017100671; herein SEQ ID NO: 1511), GTAT-TCCTTGGTTTTGAACC-CAACCGGTCTGCGCCTGTGCMNNMNNMNNMNNM NN MNNMNNTTGGGCACTCTGGTGGTTTGTC (SEQ ID NO: 63 of WO2017100671 wherein N may be A, C, T, or G; herein SEQ ID NO: 1512), GTATTCCTGGTTT-GAACCCAACCGGTCTGCGCMNNMNNMN-NAAAAGGCACCGCC AAAGTTTG (SEQ ID NO: 69 of WO2017100671 wherein N may be A, C, T, or G; herein SEQ ID NO: 1513), GTATTCCTTGGTTTGAACC-CAACCGGTCTGCGCCTGTGCMNNMNNMNN-CACCGCC AAAGTTTGGGCACT (SEQ ID NO: 70 of WO2017100671 wherein N may be A, C, T, or G; herein SEQ ID NO: 1514), GTATTCCTTGGTTTGAACC-CAACCGGTCTGCGCCTGTGCCT-TAAAAMNNMNNMNNC AAAGTTTGGGCACTCTGGTGG (SEQ ID NO: 71 of WO2017100671 wherein N may be A, C, T, or G; herein SEQ ID NO: 1515), GTATTCCTTGGTTTGAACC-CAACCGGTCTGCGCCTGTGCCT-TAAAAGGCACMNNM NNMNNTTGGGCACTCTGGTGGTTTGTG (SEQ ID NO: 72 of WO2017100671 wherein N may be A, C, T, or G; herein SEQ ID NO: 1516), ACTTTGGCGGTGCCTTT-TAAG (SEQ ID NO: 74 of WO2017100671 herein SEQ ID NO: 890), AGTGTGAGTAAGCCTTTTTTG (SEQ ID NO: 75 of WO2017100671; herein SEQ ID NO: 891), TTTACGTTGACGACGCCTAAG (SEQ ID NO: 76 of WO2017100671; herein SEQ ID NO: 892), TATACTTTGTCGCAGGGTTGG (SEQ ID NO: 77 of WO2017100671; herein SEQ ID NO: 898), or CTTGCGAAGGAGCGGCTTTCG (SEQ ID NO: 79 of WO2017100671; herein SEQ ID NO: 1517).

In one embodiment, the AAV serotype may be, or may have a sequence as described in U.S. Pat. No. 9,624,274, the contents of which are herein incorporated by reference in their entirety, such as, but not limited to, AAV1 (SEQ ID NO: 181 of U.S. Pat. No. 9,624,274), AAV6 (SEQ ID NO: 182 of U.S. Pat. No. 9,624,274), AAV2 (SEQ ID NO: 183 of U.S. Pat. No. 9,624,274), AAV3b (SEQ ID NO: 184 of U.S. Pat. No. 9,624,274), AAV7 (SEQ ID NO: 185 of U.S. Pat. No. 9,624,274), AAV8 (SEQ ID NO: 186 of U.S. Pat. No. 9,624,274), AAV10 (SEQ ID NO: 187 of U.S. Pat. No. 9,624,274), AAV4 (SEQ ID NO: 188 of U.S. Pat. No. 9,624,274), AAV11 (SEQ ID NO: 189 of U.S. Pat. No. 9,624,274), bAAV (SEQ ID NO: 190 of U.S. Pat. No. 9,624,274), AAV5 (SEQ ID NO: 191 of U.S. Pat. No. 9,624,274), GPV (SEQ ID NO: 192 of U.S. Pat. No. 9,624,274; herein SEQ ID NO: 1518), B19 (SEQ ID NO: 193 of U.S. Pat. No. 9,624,274; herein SEQ ID NO: 1519), MVM (SEQ ID NO: 194 of U.S. Pat. No. 9,624,274; herein SEQ ID NO: 1520), FPV (SEQ ID NO: 195 of U.S. Pat. No. 9,624,274; herein SEQ ID NO: 1521), CPV (SEQ ID NO: 196 of U.S. Pat. No. 9,624,274; herein SEQ ID NO: 1522) or variants thereof. Further, any of the structural protein inserts described in U.S. Pat. No. 9,624,274, may be inserted into, but not limited to, 1-453 and 1-587 of any parent AAV serotype, such as, but not limited to, AAV2 (SEQ ID NO: 183 of U.S. Pat. No. 9,624,274). The amino acid insert may be, but is not limited to, any of the following amino acid sequences, VNLTWSRASG (SEQ ID NO: 50 of U.S. Pat. No. 9,624,274; herein SEQ ID NO: 1901), EFCINHR-GYWVCGD (SEQ ID NO:55 of U.S. Pat. No. 9,624,274; herein SEQ ID NO: 1902), EDGQVMDVDLS (SEQ ID NO: 85 of U.S. Pat. No. 9,624,274; herein SEQ ID NO: 1903), EKQRNGTLT (SEQ ID NO: 86 of U.S. Pat. No. 9,624,274; herein SEQ ID NO: 1904), TYQCRVTHPHL-PRALMR (SEQ ID NO: 87 of U.S. Pat. No. 9,624,274; herein SEQ ID NO: 1905), RHSTTQPRKTKGSG (SEQ ID NO: 88 of U.S. Pat. No. 9,624,274; herein SEQ ID NO: 1906), DSNPRGVSAYLSR (SEQ ID NO: 89 of U.S. Pat. No. 9,624,274; herein SEQ ID NO: 1907), TITCLWD-LAPSK (SEQ ID NO: 90 of U.S. Pat. No. 9,624,274; herein SEQ ID NO: 1908), KTKGSGFFVF (SEQ ID NO: 91 of U.S. Pat. No. 9,624,274; herein SEQ ID NO: 1909), THPHLPRALMRS (SEQ ID NO: 92 of U.S. Pat. No. 9,624,274; herein SEQ ID NO: 1910), GETYQCRVTHPHLPRALMRSTTK (SEQ ID NO: 93 of U.S. Pat. No. 9,624,274; herein SEQ ID NO: 1911), LPRALMRS (SEQ ID NO: 94 of U.S. Pat. No. 9,624,274; herein SEQ ID NO: 1912), INHRGYWV (SEQ ID NO: 95 of U.S. Pat. No. 9,624,274; herein SEQ ID NO: 1913), CDAGSVRTNAPD (SEQ ID NO: 60 of U.S. Pat. No. 9,624,274; herein SEQ ID NO: 1914), AKAVSNLTESRS-ESLQS (SEQ ID NO: 96 of U.S. Pat. No. 9,624,274; herein SEQ ID NO: 1915), SLTGDEFKKVLET (SEQ ID NO: 97 of U.S. Pat. No. 9,624,274; herein SEQ ID NO: 1916), REAVAYRFEED (SEQ ID NO: 98 of U.S. Pat. No. 9,624, 274; herein SEQ ID NO: 1917), INPEIITLDG (SEQ ID NO: 99 of U.S. Pat. No. 9,624,274; herein SEQ ID NO: 1918), DISVTGAPVITATYL (SEQ ID NO: 100 of U.S. Pat. No. 9,624,274; herein SEQ ID NO: 1919), DISVTGAPVITA (SEQ ID NO: 101 of U.S. Pat. No. 9,624,274; herein SEQ ID NO: 1920), PKTVSNLTESSSESVQS (SEQ ID NO: 102 of U.S. Pat. No. 9,624,274; herein SEQ ID NO: 1921), SLMGDEFKAVLET (SEQ ID NO: 103 of U.S. Pat. No. 9,624,274; herein SEQ ID NO: 1922), QHSVAYTFEED (SEQ ID NO: 104 of U.S. Pat. No. 9,624,274; herein SEQ ID NO: 1923), INPEIITRDG (SEQ ID NO: 105 of U.S. Pat. No. 9,624,274; herein SEQ ID NO: 1924), DISLTGDPVITASYL (SEQ ID NO: 106 of U.S. Pat. No. 9,624,274; herein SEQ ID NO: 1925), DISLTGDPVITA (SEQ ID NO: 107 of U.S. Pat. No. 9,624,274; herein SEQ ID NO: 1926), DQSIDFEIDSA (SEQ ID NO: 108 of U.S. Pat. No. 9,624,274; herein SEQ ID NO: 1927), KNVSEDLPLPTFSPTLLGDS (SEQ ID NO: 109 of U.S. Pat. No. 9,624,274; herein SEQ ID NO: 1928), KNVSEDLPLPT (SEQ ID NO: 110 of U.S. Pat. No. 9,624,274; herein SEQ ID NO: 1929), CDSGRVRTDAPD (SEQ ID NO: 111 of U.S. Pat. No. 9,624,274; herein SEQ ID NO: 1930), FPEHLLVDFLQSLS (SEQ ID NO: 112 of U.S. Pat. No. 9,624,274; herein SEQ ID NO: 1931), DAEFRHDSG (SEQ ID NO: 65 of U.S. Pat. No. 9,624,274; herein SEQ ID NO: 1932), HYAAAQWDFGNTMCQL (SEQ ID NO: 113 of U.S. Pat. No. 9,624,274; herein SEQ ID NO: 1933), YAAQWDFGNTMCQ (SEQ ID NO: 114 of U.S. Pat. No. 9,624,274; herein SEQ ID NO: 1934), RSQKEGLHYT (SEQ ID NO: 115 of U.S. Pat. No. 9,624,274; herein SEQ ID NO: 1935), SSRTPSDKPVAHWANPQAE (SEQ ID NO: 116 of U.S. Pat. No. 9,624,274; herein SEQ ID NO: 1936), SRTPSDKPVAHWANP (SEQ ID NO: 117 of U.S. Pat. No. 9,624,274; herein SEQ ID NO: 1937), SSRTPSDKP (SEQ ID NO: 118 of U.S. Pat. No. 9,624,274; herein SEQ ID NO: 1938), NADGNVDYHMNSVP (SEQ ID NO: 119 of U.S. Pat. No. 9,624,274; herein SEQ ID NO: 1939), DGNVDYHMNSV (SEQ ID NO: 120 of U.S. Pat. No. 9,624,274; herein SEQ ID NO: 1940), RSFKEFLQSSLRALRQ (SEQ ID NO: 121 of U.S. Pat. No. 9,624,274; herein SEQ ID NO: 1941); FKEFLQSSLRA (SEQ ID NO: 122 of U.S. Pat. No. 9,624,274; herein SEQ ID NO: 1942), or QMWAPQWGPD (SEQ ID NO: 123 of U.S. Pat. No. 9,624,274; herein SEQ ID NO: 1943).

In one embodiment, the AAV serotype may be, or may have a sequence as described in U.S. Pat. No. 9,475,845, the contents of which are herein incorporated by reference in their entirety, such as, but not limited to, AAV capsid proteins comprising modification of one or more amino acids at amino acid positions 585 to 590 of the native AAV2 capsid protein. Further the modification may result in, but not limited to, the amino acid sequence RGNRQA (SEQ ID NO: 3 of U.S. Pat. No. 9,475,845; herein SEQ ID NO: 1944), SSSTDP (SEQ ID NO: 4 of U.S. Pat. No. 9,475,845; herein SEQ ID NO: 1945), SSNTAP (SEQ ID NO: 5 of U.S. Pat. No. 9,475,845; herein SEQ ID NO: 1946), SNSNLP (SEQ ID NO: 6 of U.S. Pat. No. 9,475,845; herein SEQ ID NO: 1947), SSTTAP (SEQ ID NO: 7 of U.S. Pat. No. 9,475,845; herein SEQ ID NO: 1948), AANTAA (SEQ ID NO: 8 of U.S. Pat. No. 9,475,845; herein SEQ ID NO: 1949), QQNTAP (SEQ ID NO: 9 of U.S. Pat. No. 9,475,845; herein SEQ ID NO: 1950), SAQAQA (SEQ ID NO: 10 of U.S. Pat. No. 9,475,845; herein SEQ ID NO: 1951), QANTGP (SEQ ID NO: 11 of U.S. Pat. No. 9,475,845; herein SEQ ID NO: 1952), NATTAP (SEQ ID NO: 12 of U.S. Pat. No. 9,475,845; herein SEQ ID NO: 1953), SSTAGP (SEQ ID NO: 13 and 20 of U.S. Pat. No. 9,475,845; herein SEQ ID NO: 1954), QQNTAA (SEQ ID NO: 14 of U.S. Pat. No. 9,475,845; herein SEQ ID NO: 1955), PSTAGP (SEQ ID NO: 15 of U.S. Pat. No. 9,475,845; herein SEQ ID NO: 1956), NQNTAP (SEQ ID NO: 16 of U.S. Pat. No. 9,475,845; herein SEQ ID NO: 1957), QAANAP (SEQ ID NO: 17 of U.S. Pat. No. 9,475,845; herein SEQ ID NO: 1958), SIVGLP (SEQ ID NO: 18 of U.S. Pat. No. 9,475,845; herein SEQ ID NO: 1959), AASTAA (SEQ ID NO: 19, and 27 of U.S. Pat. No. 9,475,845; herein SEQ ID NO: 1960), SQNTTA (SEQ ID NO: 21 of U.S. Pat. No. 9,475,845; herein SEQ ID NO: 1961), QQDTAP (SEQ ID NO: 22 of U.S. Pat. No. 9,475,845; herein SEQ ID NO: 1962), QTNTGP (SEQ ID NO: 23 of U.S. Pat. No. 9,475,845; herein SEQ ID NO: 1963), QTNGAP (SEQ ID NO: 24 of U.S. Pat. No. 9,475,845; herein SEQ ID NO: 1964), QQNAAP (SEQ ID NO: 25 of U.S. Pat. No. 9,475,845; herein SEQ ID NO: 1965), or AANTQA (SEQ ID NO: 26 of U.S. Pat. No. 9,475,845; herein SEQ ID NO: 1966). In one embodiment, the amino acid modification is a substitution at amino acid positions 262 through 265 in the native AAV2 capsid protein or the corresponding position in the capsid protein of another AAV with a targeting sequence. The targeting sequence may be, but is not limited to, any of the amino acid sequences, NGRAHA (SEQ ID NO: 38 of U.S. Pat. No. 9,475,845; herein SEQ ID NO: 1967), QPEHSST (SEQ ID NO: 39 and 50 of U.S. Pat. No. 9,475,845; herein SEQ ID NO: 1968), VNTANST (SEQ ID NO: 40 of U.S. Pat. No. 9,475,845; herein SEQ ID NO: 1969), HGPMQKS (SEQ ID NO: 41 of U.S. Pat. No. 9,475,845; herein SEQ ID NO: 1970), PHKPPLA (SEQ ID NO: 42 of U.S. Pat. No. 9,475,845; herein SEQ ID NO: 1971), IKNNEMW (SEQ ID NO: 43 of U.S. Pat. No. 9,475,845; herein SEQ ID NO: 1972), RNLDTPM (SEQ ID NO: 44 of U.S. Pat. No. 9,475,845; herein SEQ ID NO: 1973), VDSHRQS (SEQ ID NO: 45 of U.S. Pat. No. 9,475,845; herein SEQ ID NO: 1974), YDSKTKT (SEQ ID NO: 46 of U.S. Pat. No. 9,475,845; herein SEQ ID NO: 1975), SQLPHQK (SEQ ID NO: 47 of U.S. Pat. No. 9,475,845; herein SEQ ID NO: 1976), STMQQNT (SEQ ID NO: 48 of U.S. Pat. No. 9,475,845; herein SEQ ID NO: 1977), TERYMTQ (SEQ ID NO: 49 of U.S. Pat. No. 9,475,845; herein SEQ ID NO: 1978), DASLSTS (SEQ ID NO: 51 of U.S. Pat. No. 9,475,845; herein SEQ ID NO: 1979), DLPNKKT (SEQ ID NO: 52 of U.S. Pat. No. 9,475,845; herein SEQ ID NO: 1980), DLTAARL (SEQ ID NO: 53 of U.S. Pat. No. 9,475,845; herein SEQ ID NO: 1981), EPHQFNY (SEQ ID NO: 54 of U.S. Pat. No. 9,475,845; herein SEQ ID NO: 1982), EPQSNHT (SEQ ID NO: 55 of U.S. Pat. No. 9,475,845; herein SEQ ID NO: 1983), MSSWPSQ (SEQ ID NO: 56 of U.S. Pat. No. 9,475,845; herein SEQ ID NO: 1984), NPKHNAT (SEQ ID NO: 57 of U.S. Pat. No. 9,475,845; herein SEQ ID NO: 1985), PDGMRTT (SEQ ID NO: 58 of U.S. Pat. No. 9,475,845; herein SEQ ID NO: 1986), PNNNKTT (SEQ ID NO: 59 of U.S. Pat. No. 9,475,845; herein SEQ ID NO: 1987), QSTTHDS (SEQ ID NO: 60 of U.S. Pat. No. 9,475,845; herein SEQ ID NO: 1988), TGSKQKQ (SEQ ID NO: 61 of U.S. Pat. No. 9,475,845; herein SEQ ID NO: 1989), SLKHQAL (SEQ ID NO: 62 of U.S. Pat. No. 9,475,845; herein SEQ ID NO: 1990), SPIDGEQ (SEQ ID NO: 63 of U.S. Pat. No. 9,475,845; herein SEQ ID NO: 1991), WIFPWIQL (SEQ ID NO: 64 and 112 of U.S. Pat. No. 9,475,845; herein SEQ ID NO: 1992), CDCRGDCFC (SEQ ID NO: 65 of U.S. Pat. No. 9,475,845; herein SEQ ID NO: 1993), CNGRC (SEQ ID NO: 66 of U.S. Pat. No. 9,475,845; herein SEQ ID NO: 1994), CPRECES (SEQ ID NO: 67 of U.S. Pat. No. 9,475,845; herein SEQ ID NO: 1995), CTTHWGFTLC (SEQ ID NO: 68 and 123 of U.S. Pat. No. 9,475,845; herein SEQ ID NO: 1996), CGRRAGGSC (SEQ ID NO: 69 of U.S. Pat. No. 9,475,845; herein SEQ ID NO: 1997), CKGGRAKDC (SEQ ID NO: 70 of U.S. Pat. No. 9,475,845; herein SEQ ID NO: 1998), CVPELGHEC (SEQ ID NO: 71 and 115 of U.S. Pat. No. 9,475,845; herein SEQ ID NO: 1999), CRRETAWAK (SEQ ID NO: 72 of U.S. Pat. No. 9,475,845; herein SEQ ID NO: 2000), VSWFSHRYSPFAVS (SEQ ID NO: 73 of U.S. Pat. No. 9,475,845; herein SEQ ID NO: 2001), GYRDGYAGPILYN (SEQ ID NO: 74 of U.S. Pat. No. 9,475,845; herein SEQ ID NO: 2002), XXXYXXX (SEQ ID NO: 75 of U.S. Pat. No. 9,475,845; herein SEQ ID NO: 2003), YXNW (SEQ ID NO: 76 of U.S. Pat. No. 9,475,845; herein SEQ ID NO: 2004), RPLPPLP (SEQ ID NO: 77 of U.S. Pat. No. 9,475,845; herein SEQ ID NO: 2005), APPLPPR (SEQ ID NO: 78 of U.S. Pat. No. 9,475,845; herein SEQ ID NO: 2006), DVFYPYPYASGS (SEQ ID NO: 79 of U.S. Pat. No. 9,475,845; herein SEQ ID NO: 2007), MYWYPY (SEQ ID NO: 80 of U.S. Pat. No. 9,475,845; herein SEQ ID NO: 2008), DITWDQLWDLMK (SEQ ID NO: 81 of U.S. Pat. No. 9,475,845; herein SEQ ID NO: 2009), CWDDXWLC (SEQ ID NO: 82 of U.S. Pat. No. 9,475,845; herein SEQ ID NO: 2010), EWCEYLGGYLRCYA (SEQ ID NO: 83 of U.S. Pat. No. 9,475,845; herein SEQ ID NO: 2011), YXCXXGPXTWXCXP (SEQ ID NO: 84 of U.S. Pat. No. 9,475,845; herein SEQ ID NO: 2012), IEGPTLRQWLAARA (SEQ ID NO: 85 of U.S. Pat. No. 9,475,845; herein SEQ ID NO: 2013), LWXXX (SEQ ID NO: 86 of U.S. Pat. No. 9,475,845; herein SEQ ID NO: 2014), XFXXYLW (SEQ ID NO: 87 of U.S. Pat. No. 9,475,845; herein SEQ ID NO: 2015), SSIISHFRWGLCD (SEQ ID NO: 88 of U.S. Pat. No. 9,475,845; herein SEQ ID NO: 2016), MSRPACPPNDKYE (SEQ ID NO: 89 of U.S. Pat. No. 9,475,845; herein SEQ ID NO: 2017), CLRSGRGC (SEQ ID NO: 90 of U.S. Pat. No. 9,475,845; herein SEQ ID NO: 2018), CHWMFSPWC (SEQ ID NO: 91 of U.S. Pat. No. 9,475,845; herein SEQ ID NO: 2019), WXXF (SEQ ID NO: 92 of U.S. Pat. No. 9,475,845; herein SEQ ID NO: 2020), CSSRLDAC (SEQ ID NO: 93 of U.S. Pat. No. 9,475,845; herein SEQ ID NO: 2021), CLPVASC (SEQ ID NO: 94 of U.S. Pat. No. 9,475,845; herein SEQ ID NO: 2022), CGFECVRQCPERC (SEQ ID NO: 95 of U.S. Pat. No. 9,475,845; herein SEQ ID NO: 2023), CVALCREACGEGC (SEQ ID NO: 96 of U.S. Pat. No. 9,475,845; herein SEQ ID NO: 2024), SWCEPGWCR (SEQ ID NO: 97 of U.S. Pat. No. 9,475,845; herein SEQ ID NO: 2025), YSGKWGW (SEQ ID NO: 98 of U.S. Pat. No. 9,475,845; herein SEQ ID NO: 2026), GLSGGRS (SEQ ID NO: 99 of U.S. Pat. No. 9,475,845; herein SEQ ID NO: 2027), LMLPRAD (SEQ ID NO: 100 of U.S. Pat. No. 9,475,845; herein SEQ ID NO: 2028), CSCFRDVCC (SEQ ID NO: 101 of U.S. Pat. No. 9,475,845; herein SEQ ID NO: 2029), CRDVVSVIC (SEQ ID NO: 102 of U.S. Pat. No. 9,475,845; herein SEQ ID NO: 2030), MARSGL (SEQ ID NO: 103 of U.S. Pat. No. 9,475,845; herein SEQ ID NO: 2031), MARAKE (SEQ ID NO: 104 of U.S. Pat. No. 9,475,845; herein SEQ ID NO: 2032), MSRTMS (SEQ ID NO: 105 of U.S. Pat. No. 9,475,845; herein SEQ ID NO: 2033), KCCYSL (SEQ ID NO: 106 of U.S. Pat. No. 9,475,845, herein SEQ ID NO: 2034), MYWGDSHWLQYWYE (SEQ ID NO: 107 of U.S. Pat. No. 9,475,845; herein SEQ ID NO: 2035), MQLPLAT (SEQ ID NO: 108 of U.S. Pat. No. 9,475,845; herein SEQ ID NO: 2036), EWLS (SEQ ID NO: 109 of U.S. Pat. No. 9,475,845; herein SEQ ID NO: 2037), SNEW (SEQ ID NO: 110 of U.S. Pat. No. 9,475,845; herein SEQ ID NO: 2038), TNYL (SEQ ID NO: 111 of U.S. Pat. No. 9,475,845; herein SEQ ID NO: 2039), WDLAWMFRLPVG (SEQ ID NO: 113 of U.S. Pat. No. 9,475,845; herein SEQ ID NO: 2040), CTVALPGGYVRVC (SEQ ID NO: 114 of U.S. Pat. No. 9,475,845; herein SEQ ID NO: 2041), CVAYCIEHHCWTC (SEQ ID NO: 116 of U.S. Pat. No. 9,475,845; herein SEQ ID NO: 2042), CVFAHNYDYLVC (SEQ ID NO: 117 of U.S. Pat. No. 9,475,845; herein SEQ ID NO: 2043), CVFTSNYAFC (SEQ ID NO: 118 of U.S. Pat. No. 9,475,845; herein SEQ ID NO: 2044), VHSPNKK (SEQ ID NO: 119 of U.S. Pat. No. 9,475,845 herein SEQ ID NO: 2045), CRGDGWC (SEQ ID NO: 120 of U.S. Pat. No. 9,475,845; herein SEQ ID NO: 2046), XRGCDX (SEQ ID NO: 121 of U.S. Pat. No. 9,475,845; herein SEQ ID NO: 2047), PXXX (SEQ ID NO: 122 of U.S. Pat. No. 9,475,845; herein SEQ ID NO: 2048), SGKGPRQITAL (SEQ ID NO: 124 of U.S. Pat. No. 9,475,845; herein SEQ ID NO: 2049), AAAAAAAAAXXXXX (SEQ ID NO: 125 of U.S. Pat. No. 9,475,845; herein SEQ ID NO: 2050), VYMSPF (SEQ ID NO: 126 of U.S. Pat. No. 9,475,845; herein SEQ ID NO: 2051), ATWLPPR (SEQ ID NO: 127 of U.S. Pat. No. 9,475,845; herein SEQ ID NO: 2052), HTMYYHHHYQHHL (SEQ ID NO: 128 of U.S. Pat. No. 9,475,845; herein SEQ ID NO: 2053), SEVGCRAGPLQWLCEKYFG (SEQ ID NO: 129 of U.S. Pat. No. 9,475,845; herein SEQ ID NO: 2054), CGLLPVGRPDRNVWRWLC (SEQ ID NO: 130 of U.S. Pat. No. 9,475,845; herein SEQ ID NO: 2055), CKGQCDRFKGLPWEC (SEQ ID NO: 131 of U.S. Pat. No. 9,475,845; herein SEQ ID NO: 2056), SGRSA (SEQ ID NO: 132 of U.S. Pat. No. 9,475,845; herein SEQ ID NO: 2057), WGFP (SEQ ID NO: 133 of U.S. Pat. No. 9,475,845 herein SEQ ID NO: 2058), AEPMPHSLNFSQYLWYT (SEQ ID NO: 134 of U.S. Pat. No. 9,475,845; herein SEQ ID NO: 2059), WAYXSP (SEQ ID NO: 135 of U.S. Pat. No. 9,475,845; herein SEQ ID NO: 2060), IELLQAR (SEQ ID NO: 136 of US9475845; herein SEQ ID NO: 2061), AYTKCSRQWRTCMTTH (SEQ ID NO: 137 of U.S. Pat. No. 9,475,845; herein SEQ ID NO: 2062), PQNSKIPGPTFLDPH (SEQ ID NO: 138 of U.S. Pat. No. 9,475,845; herein SEQ ID NO: 2063), SMEPALPDWWWKMFK (SEQ ID NO: 139 of U.S. Pat. No. 9,475,845; herein SEQ ID NO: 2064), ANTPCGPYTHDCPVKR (SEQ ID NO: 140 of U.S. Pat. No. 9,475,845; herein SEQ ID NO: 2065), TACHQHVRMVRP (SEQ ID NO: 141 of U.S. Pat. No. 9,475,845; herein SEQ ID NO: 2066), VPWMEPAYQRFL (SEQ ID NO: 142 of U.S. Pat. No. 9,475,845; herein SEQ ID NO: 2067), DPRATPGS (SEQ ID NO: 143 of U.S. Pat. No. 9,475,845; herein SEQ ID NO: 2068), FRPNRAQDYNTN (SEQ ID NO: 144 of U.S. Pat. No. 9,475,845; herein SEQ ID NO: 2069), CTKNSYLMC (SEQ ID NO: 145 of U.S. Pat. No. 9,475,845; herein SEQ ID NO: 2070), CXXTXXXGXGC (SEQ ID NO: 146 of U.S. Pat. No. 9,475,845; herein SEQ ID NO: 2071), CPIEDRPMC (SEQ ID NO: 147 of U.S. Pat. No. 9,475,845; herein SEQ ID NO: 2072), HEWSYLAPYPWF (SEQ ID NO: 148 of U.S. Pat. No. 9,475,845; herein SEQ ID NO: 2073), MCPKHPLGC (SEQ ID NO: 149 of U.S. Pat. No. 9,475,845; herein SEQ ID NO: 2074), RMWPSSTVNLSAGRR (SEQ ID NO: 150 of U.S. Pat. No. 9,475,845; herein SEQ ID NO: 2075), SAKTAVSQRVWLPSHRGGEP (SEQ ID NO: 151 of U.S. Pat. No. 9,475,845; herein SEQ ID NO: 2076), KSREHVNNSACPSKRITAAL (SEQ ID NO: 152 of U.S. Pat. No. 9,475,845; herein SEQ ID NO: 2077), EGFR (SEQ ID NO: 153 of U.S. Pat. No. 9,475,845; herein SEQ ID NO: 2078), AGLGVR (SEQ ID NO: 154 of U.S. Pat. No. 9,475,845; herein SEQ ID NO: 2079), GTRQGHTMRLGVSDG (SEQ ID NO: 155 of U.S. Pat. No. 9,475,845; herein SEQ ID NO: 2080), IAGLATPGWSHWLAL (SEQ ID NO: 156 of U.S. Pat. No. 9,475,845; herein SEQ ID NO: 2081), SMSIARL (SEQ ID NO: 157 of U.S. Pat. No. 9,475,845; herein SEQ ID NO:

2082), HTFEPGV (SEQ ID NO: 158 of U.S. Pat. No. 9,475,845; herein SEQ ID NO: 2083), NTSLKRISNKRIRRK (SEQ ID NO: 159 of U.S. Pat. No. 9,475,845; herein SEQ ID NO: 2084), LRIKRKRRKRKKTRK (SEQ ID NO: 160 of U.S. Pat. No. 9,475,845; herein SEQ ID NO: 2085), GGG, GFS, LWS, EGG, LLV, LSP, LBS, AGG, GRR, GGH and GTV.

In one embodiment, the AAV serotype may be, or may have a sequence as described in United States Publication No. US 20160369298, the contents of which are herein incorporated by reference in their entirety, such as, but not limited to, site-specific mutated capsid protein of AAV2 (SEQ ID NO: 97 of US 20160369298; herein SEQ ID NO: 2086) or variants thereof, wherein the specific site is at least one site selected from sites R447, G453, S578, N587, N587+1, S662 of VP1 or fragment thereof.

Further, any of the mutated sequences described in US 20160369298, may be or may have, but not limited to, any of the following sequences SDSGASN (SEQ ID NO: 1 and SEQ ID NO: 231 of US20160369298; herein SEQ ID NO: 2087), SPSGASN (SEQ ID NO: 2 of US20160369298; herein SEQ ID NO: 2088), SHSGASN (SEQ ID NO: 3 of US20160369298; herein SEQ ID NO: 2089), SRSGASN (SEQ ID NO: 4 of US20160369298; herein SEQ ID NO: 2090), SKSGASN (SEQ ID NO: 5 of US20160369298; herein SEQ ID NO: 2091), SNSGASN (SEQ ID NO: 6 of US20160369298; herein SEQ ID NO: 2092), SGSGASN (SEQ ID NO: 7 of US20160369298; herein SEQ ID NO: 2093), SASGASN (SEQ ID NO: 8, 175, and 221 of US20160369298; herein SEQ ID NO: 2094), SESGTSN (SEQ ID NO: 9 of US20160369298; herein SEQ ID NO: 2095), STTGGSN (SEQ ID NO: 10 of US20160369298; herein SEQ ID NO: 2096), SSAGSTN (SEQ ID NO: 11 of US20160369298; herein SEQ ID NO: 2097), NNDSQA (SEQ ID NO: 12 of US20160369298; herein SEQ ID NO: 2098), NNRNQA (SEQ ID NO: 13 of US20160369298; herein SEQ ID NO: 2099), NNNKQA (SEQ ID NO: 14 of US20160369298; herein SEQ ID NO: 2100), NAKRQA (SEQ ID NO: 15 of US20160369298; herein SEQ ID NO: 2101), NDEHQA (SEQ ID NO: 16 of US20160369298; herein SEQ ID NO: 2102), NTSQKA (SEQ ID NO: 17 of US20160369298; herein SEQ ID NO: 2103), YYLSRTNTPSGTDTQSRLVFSQAGA (SEQ ID NO: 18 of US20160369298; herein SEQ ID NO: 2104), YYLSRTNTDSGTETQSGLDFSQAGA (SEQ ID NO: 19 of US20160369298; herein SEQ ID NO: 2105), YYLSRTNTESGTPTQSALEFSQAGA (SEQ ID NO: 20 of US20160369298; herein SEQ ID NO: 2106), YYLSRTNTHSGTHTQSPLHFSQAGA (SEQ ID NO: 21 of US20160369298; herein SEQ ID NO: 2107), YYLSRTNTSSGTITISHLIFSQAGA (SEQ ID NO: 22 of US20160369298; herein SEQ ID NO: 2108), YYLSRTNTRSGIMTKSSLMFSQAGA (SEQ ID NO: 23 of US20160369298; herein SEQ ID NO: 2109), YYLSRTNTKSGRKTLSNLFSQAGA (SEQ ID NO: 24 of US20160369298; herein SEQ ID NO: 2110), YYLSRTNDGSGPVTPSKLRFSQRGA (SEQ ID NO: 25 of US20160369298; herein SEQ ID NO: 2111), YYLSRTNAASGHATHSDLKFSQPGA (SEQ ID NO: 26 of US20160369298; herein SEQ ID NO: 2112), YYLSRTNGQAGSLTMSELGFSQVGA (SEQ ID NO: 27 of US20160369298; herein SEQ ID NO: 2113), YYLSRTNSTGGNQTTSQLLFSQLSA (SEQ ID NO: 28 of US20160369298; herein SEQ ID NO: 2114), YFLSRTNNNTGLNTNSTLNFSQGRA (SEQ ID NO: 29 of US20160369298; herein SEQ ID NO: 2115), SKTGADNNNSEYSWTG (SEQ ID NO: 30 of US20160369298; herein SEQ ID NO: 2116), SKTDADNNNSEYSWTG (SEQ ID NO: 31 of US20160369298; herein SEQ ID NO: 2117), SKTEADNNNSEYSWTG (SEQ ID NO: 32 of US20160369298; herein SEQ ID NO: 2118), SKTPADNNNSEYSWTG (SEQ ID NO: 33 of US20160369298; herein SEQ ID NO: 2119), SKTHADNNNSEYSWTG (SEQ ID NO: 34 of US20160369298; herein SEQ ID NO: 2120), SKTQADNNNSEYSWTG (SEQ ID NO: 35 of US20160369298; herein SEQ ID NO: 2121), SKTIADNNNSEYSWTG (SEQ ID NO: 36 of US20160369298; herein SEQ ID NO: 2122), SKTMADNNNSEYSWTG (SEQ ID NO: 37 of US20160369298; herein SEQ ID NO: 2123), SKTRADNNNSEYSWTG (SEQ ID NO: 38 of US20160369298; herein SEQ ID NO: 2124), SKTNADNNNSEYSWTG (SEQ ID NO: 39 of US20160369298; herein SEQ ID NO: 2125), SKTVGRNNNSEYSWTG (SEQ ID NO: 40 of US20160369298; herein SEQ ID NO: 2126), SKTADRNNNSEYSWTG (SEQ ID NO: 41 of US20160369298; herein SEQ ID NO: 2127), SKKLSQNNNSKYSWQG (SEQ ID NO: 42 of US20160369298; herein SEQ ID NO: 2128), SKPTTGNNNSDYSWPG (SEQ ID NO: 43 of US20160369298; herein SEQ ID NO: 2129), STQKNENNNSNYSWPG (SEQ ID NO: 44 of US20160369298; herein SEQ ID NO: 2130), HKDDEGKF (SEQ ID NO: 45 of US20160369298; herein SEQ ID NO: 2131), HKDDNRKF (SEQ ID NO: 46 of US20160369298; herein SEQ ID NO: 2132), HKDDTNKF (SEQ ID NO: 47 of US20160369298; herein SEQ ID NO: 2133), HEDSDKNF (SEQ ID NO: 48 of US20160369298; herein SEQ ID NO: 2134), HRDGADSF (SEQ ID NO: 49 of US20160369298; herein SEQ ID NO: 2135), HGDNKSRF (SEQ ID NO: 50 of US20160369298; herein SEQ ID NO: 2136), KQGSEKTNVDFEEV (SEQ ID NO: 51 of US20160369298; herein SEQ ID NO: 2137), KQGSEKTNVDSEEV (SEQ ID NO: 52 of US20160369298; herein SEQ ID NO: 2138), KQGSEKTNVDVEEV (SEQ ID NO: 53 of US20160369298; herein SEQ ID NO: 2139), KQGSDKTNVDDAGV (SEQ ID NO: 54 of US20160369298; herein SEQ ID NO: 2140), KQGSSKTNVDPREV (SEQ ID NO: 55 of US20160369298; herein SEQ ID NO: 2141), KQGSRKTNVDHKQV (SEQ ID NO: 56 of US20160369298; herein SEQ ID NO: 2142), KQGSKGGNVDTNRV (SEQ ID NO: 57 of US20160369298; herein SEQ ID NO: 2143), KQGSGEANVDNGDV (SEQ ID NO: 58 of US20160369298; herein SEQ ID NO: 2144), KQDAAADNIDYDHV (SEQ ID NO: 59 of US20160369298; herein SEQ ID NO: 2145), KQSGTRSNAAASSV (SEQ ID NO: 60 of US20160369298; herein SEQ ID NO: 2146), KENTNTNDTELTNV (SEQ ID NO: 61 of US20160369298; herein SEQ ID NO: 2147), QRGNNVAATADVNT (SEQ ID NO: 62 of US20160369298; herein SEQ ID NO: 2148), QRGNNEAATADVNT (SEQ ID NO: 63 of US20160369298; herein SEQ ID NO: 2149), QRGNNPAATADVNT (SEQ ID NO: 64 of US20160369298; herein SEQ ID NO: 2150), QRGNNHAATADVNT (SEQ ID NO: 65 of US20160369298; herein SEQ ID NO: 2151), QEENNIAATPGVNT (SEQ ID NO: 66 of US20160369298; herein SEQ ID NO: 2152), QPPNNMAATHEVNT (SEQ ID NO: 67 of US20160369298; herein SEQ ID NO: 2153), QHHNNSAATTIVNT (SEQ ID NO: 68 of US20160369298; herein SEQ ID NO: 2154), QTTNN-RAAFNMVET (SEQ ID NO: 69 of US20160369298; herein SEQ ID NO: 2155), QKKNNNAASKKVAT (SEQ ID NO: 70 of US20160369298; herein SEQ ID NO: 2156), QGG-NNKAADDAVKT (SEQ ID NO: 71 of US20160369298; herein SEQ ID NO: 2157), QAAKGGAADDAVKT (SEQ ID NO: 72 of US20160369298; herein SEQ ID NO: 2158), QDDRAAAANESVDT (SEQ ID NO: 73 of US20160369298; herein SEQ ID NO: 2159), QQQHD-DAAYQRVHT (SEQ ID NO: 74 of US20160369298; herein SEQ ID NO: 2160), QSSSSLAAVSTVQT (SEQ ID NO: 75 of US20160369298; herein SEQ ID NO: 2161), QNNQT-TAAIRNVTT (SEQ ID NO: 76 of US20160369298; herein SEQ ID NO: 2162), NYNKKSDNVDFT (SEQ ID NO: 77 of US20160369298; herein SEQ ID NO: 2163), NYNKKSENVDFT (SEQ ID NO: 78 of US20160369298; herein SEQ ID NO: 2164), NYNKKSLNVDFT (SEQ ID NO: 79 of US20160369298; herein SEQ ID NO: 2165), NYNKKSPNVDFT (SEQ ID NO: 80 of US20160369298; herein SEQ ID NO: 2166), NYSKKSHCVDFT (SEQ ID NO: 81 of US20160369298; herein SEQ ID NO: 2167), NYRKTIYVDFT (SEQ ID NO: 82 of US20160369298; herein SEQ ID NO: 2168), NYKEKKDVHFT (SEQ ID NO: 83 of US20160369298; herein SEQ ID NO: 2169), NYGHRAIVQFT (SEQ ID NO: 84 of US20160369298; herein SEQ ID NO: 2170), NYANHQFVVCT (SEQ ID NO: 85 of US20160369298; herein SEQ ID NO: 2171), NYDD-DPTGVLLT (SEQ ID NO: 86 of US20160369298; herein SEQ ID NO: 2172), NYDDPTGVLLT (SEQ ID NO: 87 of US20160369298; herein SEQ ID NO: 2173), NFEQQNS-VEWT (SEQ ID NO: 88 of US20160369298; herein SEQ ID NO: 2174), SQSGASN (SEQ ID NO: 89 and SEQ ID NO: 241 of US20160369298; herein SEQ ID NO: 2175), NNG-SQA (SEQ ID NO: 90 of US20160369298; herein SEQ ID NO: 2176), YYLSRTNTPSGTTTWSRLQFSQAGA (SEQ ID NO: 91 of US20160369298; herein SEQ ID NO: 2177), SKTSADNNNSEYSWTG (SEQ ID NO: 92 of US20160369298; herein SEQ ID NO: 2178), HKDDEEKF (SEQ ID NO: 93, 209, 214, 219, 224, 234, 239, and 244 of US20160369298; herein SEQ ID NO: 2179), KQGSEKTNVDIEEV (SEQ ID NO: 94 of US20160369298; herein SEQ ID NO: 2180), QRGNNQAATADVNT (SEQ ID NO: 95 of US20160369298; herein SEQ ID NO: 2181), NYNKKSVNVDFT (SEQ ID NO: 96 of US20160369298; herein SEQ ID NO: 2182), SQSGASNYN-TPSGTTTQSRLQFSTSADNNNSEYSWTGATKYH (SEQ ID NO: 106 of US20160369298; herein SEQ ID NO: 2183), SASGASNFNSEGGSLTQSSLGFSTDGENNNSDFSWT-GATKYH (SEQ ID NO: 107 of US20160369298; herein SEQ ID NO: 2184), SQSGASNYNTPSGTTTQSRLQF-STDGENNNSDFSWTGATKYH (SEQ ID NO: 108 of US20160369298; herein SEQ ID NO: 2185), SAS-GASNYNTPSGTTTQSRLQFSTSADNNNSEFSWPGAT-TYH (SEQ ID NO: 109 of US20160369298; herein SEQ ID NO: 2186), SQSGASNFNSEGGSLTQSSLGFSTD-GENNNSDFSWTGATKYH (SEQ ID NO: 110 of US20160369298; herein SEQ ID NO: 2187), SAS-GASNYNTPSGSLTQSSLGFSTDGENNNSDFSWTGAT-KYH (SEQ ID NO: 111 of US20160369298; herein SEQ ID NO: 2188), SQSGASNYNTPSGTTTQSRLQFST-SADNNNSDFSWTGATKYH (SEQ ID NO: 112 of US20160369298; herein SEQ ID NO: 2189), SGA-GASNFNSEGGSLTQSSLGFSTDGENNNSDFSWTGAT-KYH (SEQ ID NO: 113 of US20160369298; herein SEQ ID NO: 2190), SGAGASN (SEQ ID NO: 176 of US20160369298; herein SEQ ID NO: 2191), NSEGGSLTQSSLGFS (SEQ ID NO: 177, 185, 193 and 202 of US20160369298; herein SEQ ID NO: 2192), TDGENNNSDFS (SEQ ID NO: 178 of US20160369298; herein SEQ ID NO: 2193), SEFSWPGATT (SEQ ID NO: 179 of US20160369298; herein SEQ ID NO: 2194), TSADNNNSDFSWT (SEQ ID NO: 180 of US20160369298; herein SEQ ID NO: 2195), SQSGASNY (SEQ ID NO: 181, 187, and 198 of US20160369298; herein SEQ ID NO: 2196), NTPSGTTTQSRLQFS (SEQ ID NO: 182, 188, 191, and 199 of US20160369298; herein SEQ ID NO: 2197), TSADNNNSEYSWTGATKYH (SEQ ID NO: 183 of US20160369298; herein SEQ ID NO: 2198), SAS-GASNF (SEQ ID NO: 184 of US20160369298; herein SEQ ID NO: 2199), TDGENNNSDFSWTGATKYH (SEQ ID NO: 186, 189, 194, 197, and 203 of US20160369298; herein SEQ ID NO: 2200), SASGASNY (SEQ ID NO: 190 and SEQ ID NO: 195 of US20160369298; herein SEQ ID NO: 2201), TSADNNNSEFSWPGATTYH (SEQ ID NO: 192 of US20160369298; herein SEQ ID NO: 2202), NTPSGSLTQSSLGFS (SEQ ID NO: 196 of US20160369298; herein SEQ ID NO: 2203), TSADNNNSDFSWTGATKYH (SEQ ID NO: 200 of US20160369298; herein SEQ ID NO: 2204), SGAGASNF (SEQ ID NO: 201 of US20160369298; herein SEQ ID NO: 2205), CTCCAGVVSVVSMRSRVCVNSGCAGCTDHCVVSRN-SGTCVMSACACAA (SEQ ID NO: 204 of US20160369298; herein SEQ ID NO: 2206), CTCCAGAGAGGCAACAGACAAGCAGCTACCGCA-GATGTCAACACACAA (SEQ ID NO: 205 of US20160369298; herein SEQ ID NO: 2207), SAAGASN (SEQ ID NO: 206 of US20160369298; herein SEQ ID NO: 2208), YFLSRTNTESGSTTQSTLRFSQAG (SEQ ID NO: 207 of US20160369298; herein SEQ ID NO: 2209), SKT-SADNNNSDFS (SEQ ID NO: 208, 228, and 253 of US20160369298; herein SEQ ID NO: 2210), KQGSEKTDVDIDKV (SEQ ID NO: 210 of US20160369298; herein SEQ ID NO: 2211), STAGASN (SEQ ID NO: 211 of US20160369298; herein SEQ ID NO: 2212), YFLSRTNTTTSGIETQSTLRFSQAG (SEQ ID NO: 212 and SEQ ID NO: 247 of US20160369298; herein SEQ ID NO: 2213), SKTDGENNNSDFS (SEQ ID NO: 213 and SEQ ID NO: 248 of US20160369298; herein SEQ ID NO: 2214), KQGAAADDVEIDGV (SEQ ID NO: 215 and SEQ ID NO: 250 of US20160369298; herein SEQ ID NO: 2215), SEAGASN (SEQ ID NO: 216 of US20160369298; herein SEQ ID NO: 2216), YYLSRTNTPSGTTTQSRLQFSQAG (SEQ ID NO: 217, 232 and 242 of US20160369298; herein SEQ ID NO: 2217), SKTSADNNNSEYS (SEQ ID NO: 218, 233, 238, and 243 of US20160369298; herein SEQ ID NO: 2218), KQGSEKTNVDIEKV (SEQ ID NO: 220, 225 and 245 of US20160369298; herein SEQ ID NO: 2219), YFLSRTNDASGSDTKSTLLFSQAG (SEQ ID NO: 222 of US20160369298; herein SEQ ID NO: 2220), STTPSENNN-SEYS (SEQ ID NO: 223 of US20160369298; herein SEQ ID NO: 2221), SAAGATN (SEQ ID NO: 226 and SEQ ID NO: 251 of US20160369298; herein SEQ ID NO: 2222), YFLSRTNGEAGSATLSELRFSQAG (SEQ ID NO: 227 of US20160369298; herein SEQ ID NO: 2223), HGDDADRF (SEQ ID NO: 229 and SEQ ID NO: 254 of US20160369298; herein SEQ ID NO: 2224), KQGAEKSDVEVDRV (SEQ ID NO: 230 and SEQ ID NO: 255 of US20160369298; herein SEQ ID NO: 2225), KQDSGGDNIDIDQV (SEQ ID NO: 235 of US20160369298; herein SEQ ID NO: 2226), SDA-GASN (SEQ ID NO: 236 of US20160369298; herein SEQ ID NO: 2227), YFLSRTNTEGGHDTQSTLRFSQAG (SEQ ID NO: 237 of US20160369298; herein SEQ ID NO: 2228), KEDGGGSDVAIDEV (SEQ ID NO: 240 of US20160369298; herein SEQ ID NO: 2229), SNAGASN (SEQ ID NO: 246 of US20160369298; herein SEQ ID NO: 2230), and YFLSRTNGEAGSATLSELRFSQPG (SEQ ID NO: 252 of US20160369298; herein SEQ ID NO: 2231). Non-limiting examples of nucleotide sequences that may encode the amino acid mutated sites include the following, AGCVVMDCAGGARSCASCAAC (SEQ ID NO: 97 of US20160369298; herein SEQ ID NO: 2232), AACRACRRSMRSMAGGCA (SEQ ID NO: 98 of US20160369298; herein SEQ ID NO: 2233), CACRRGGACRRCRMSRRSARSITF (SEQ ID NO: 99 of US20160369298; herein SEQ ID NO: 2234), TATTTCTGAGCAGAACAAACRVCVVSRSCGGAMNCVHSACGMHSTCAVVSCTFVDS TTTTCTCAGSBCRGSGCG (SEQ ID NO: 100 of US20160369298; herein SEQ ID NO: 2235), TCAAMAMMAVNSRVCSR-SAACAACAACAGTRASTTCTCGTGGMMAGGA (SEQ ID NO: 101 of US20160369298; herein SEQ ID NO: 2236), AAGSAARRCRSCRVSRVARVCRA-TRYCGMSNHCRVMVRSGTC (SEQ ID NO: 102 of US20160369298; herein SEQ ID NO: 2237), CAGVVSVVSMRSRVCVNSGCAGCTDHCVVSRN-SGTCVMSACA (SEQ ID NO: 103 of US20160369298; herein SEQ ID NO: 2238), AACTWCRVSVASMVSVHSDDTGTGSWSTKSACT (SEQ ID NO: 104 of US20160369298; herein SEQ ID NO: 2239), TTGTTGAACATCACCACGTGACGCACGTTC (SEQ ID NO: 256 of US20160369298; herein SEQ ID NO: 2240), TCCCCGTGGTTCTACTACATAATGTGGCCG (SEQ ID NO: 257 of US20160369298; herein SEQ ID NO: 2241), TTCCACACTCCGTTTTGGATAATGTTGAAC (SEQ ID NO: 258 of US20160369298; herein SEQ ID NO: 2242), AGGGACATCCCCAGCTCCATGCTGTGGTCG (SEQ ID NO: 259 of US20160369298; herein SEQ ID NO: 2243), AGGGACAACCCCTCCGACTCGCCCTAATCC (SEQ ID NO: 260 of US20160369298; herein SEQ ID NO: 2244), TCCTAGTAGAAGACACCCTCTCACTGCCCG (SEQ ID NO: 261 of US20160369298; herein SEQ ID NO: 2245), AGTACCATGTACACCCACTCTCCCAGTGCC (SEQ ID NO: 262 of US20160369298; herein SEQ ID NO: 2246), ATATGGACGTTCATGCTGATCACCATACCG (SEQ ID NO: 263 of US20160369298; herein SEQ ID NO: 2247), AGCAGGAGCTCCTTGGCCTCAGCGTGCGAG (SEQ ID NO: 264 of US20160369298; herein SEQ ID NO: 2248), ACAAGCAGCTCACTATGACAACCACTGAC (SEQ ID NO: 265 of US20160369298; herein SEQ ID NO: 2249), CAGCCTAGGAACTGGCTTCCTGGACCCTGTTACCGCCAGCAGAGAGTCTCAAMAMM AVNSRVCSRSAACAACAACAGTRASTTCTCCTGGMMAGGAGCTACCAAGTACCACC TCAATGGCAGAGACTCTCTGGT-GAATCCCGGACCAGCTATGGCAAGCCACRRGGAC RRCRMSRRSARSTTTTTTCCTCAGAGCGGGGTTCTCATCTTGGGAAGSAARRCRSCR VSRVARVCRA-TRYCGMSNHCRVMVRSGTCATGATTACA-GACGAAGAGGAGATCTGG AC (SEQ ID NO: 266 of US20160369298; herein SEQ ID NO: 2250), TGGACAATGGCGGTCGTCTCTCAGAGTTKTKKT (SEQ ID NO: 267 of US20160369298; herein SEQ ID NO: 2251), AGAGGACCKKTCCTCGATGGTTCATGGTG-GAGTTA (SEQ ID NO: 268 of US20160369298; herein SEQ ID NO: 2252), CCACTTAGGGCCTGGTCGA-TACCGTTCGGTG (SEQ ID NO: 269 of US20160369298; herein SEQ ID NO: 2253), and TCTCGCCC-CAAGAGTAGAAACCCTFCSTTYYG (SEQ ID NO: 270 of US20160369298; herein SEQ ID NO: 2254).

In some embodiments, the AAV serotype may comprise an ocular cell targeting peptide as described in International Patent Publication WO2016134375, the contents of which are herein incorporated by reference in their entirety, such as, but not limited to SEQ ID NO: 9, and SEQ ID NO: 10 of WO2016134375. Further, any of the ocular cell targeting peptides or amino acids described in WO2016134375, may be inserted into any parent AAV serotype, such as, but not limited to, AAV2 (SEQ ID NO:8 of WO2016134375; herein SEQ ID NO: 2255), or AAV9 (SEQ ID NO: 11 of WO2016134375; herein SEQ ID NO: 2256). In some embodiments, modifications, such as insertions are made in AAV2 proteins at P34-A35, T138-A139, A139-P140, G453-T454, N587-R588, and/or R588-Q589. In certain embodiments, insertions are made at D384, G385, I560, T561, N562, E563, E564, E565, N704, and/or Y705 of AAV9. The ocular cell targeting peptide may be, but is not limited to, any of the following amino acid sequences, GSTPPPM (SEQ ID NO: 1 of WO2016134375; herein SEQ ID NO: 2257), or GETRAPL (SEQ ID NO: 4 of WO2016134375; herein SEQ ID NO: 2258).

In some embodiments, the AAV serotype may be modified as described in the United States Publication US 20170145405 the contents of which are herein incorporated by reference in their entirety, AAV serotypes may include, modified AAV2 (e.g., modifications at Y444F, Y500F, Y730F and/or S662V), modified AAV3 (e.g., modifications at Y705F, Y731F and/or T492V), and modified AAV6 (e.g., modifications at S663V and/or T492V).

In some embodiments, the AAV serotype may be modified as described in the International Publication WO2017083722 the contents of which are herein incorporated by reference in their entirety, AAV serotypes may include, AAV1 (Y705+731F+T492V), AAV2 (Y444+500+730F+T491V), AAV3 (Y705+731F), AAV5, AAV 5(Y436+693+719F), AAV6 (VP3 variant Y705F/Y731F/T492V), AAV8 (Y733F), AAV9, AAV9 (VP3 variant Y731F), and AAV10 (Y733F).

In some embodiments, the AAV serotype may comprise, as described in International Patent Publication WO2017015102, the contents of which are herein incorporated by reference in their entirety, an engineered epitope comprising the amino acids SPAKFA (SEQ ID NO: 24 of WO2017015102, herein SEQ ID NO: 2259) or NKDKLN (SEQ ID NO:2 of WO2017015102; herein SEQ ID NO: 2260). The epitope may be inserted in the region of amino acids 665 to 670 based on the numbering of the VP1 capsid of AAV8 (SEQ ID NO:3 of WO2017015102) and/or residues 664 to 668 of AAV3B (SEQ ID NO:3).

In one embodiment, the AAV serotype may be, or may have a sequence as described in International Patent Publication WO2017058892, the contents of which are herein incorporated by reference in their entirety, such as, but not limited to, AAV variants with capsid proteins that may comprise a substitution at one or more (e.g., 2, 3, 4, 5, 6, or 7) of amino acid residues 262-268, 370-379, 451-459, 472-473, 493-500, 528-534, 547-552, 588-597, 709-710, 716-722 of AAV1, in any combination, or the equivalent amino acid residues in AAV2, AAV3, AAV4, AAV5, AAV6, AAV7, AAV8, AAV9, AAV10, AAV11, AAV12, AAVrh8 AAVrh10, AAVrh32.33, bovine AAV or avian AAV. The amino acid substitution may be, but is not limited to, any of the amino acid sequences described in WO2017058892. In one embodiment, the AAV may comprise an amino acid substitution at residues 256L, 258K, 259Q, 261S, 263A, 264S, 265T, 266G, 272H, 385S, 386Q, S472R, V473D, N500E547S, 709A, 710N, 716D, 717N, 718N, 720L, A456T, Q457T, N458Q, K459S, T492S, K493A, S586R, S587G, S588N, T589R and/or 722T of AAV1 (SEQ ID NO: 1 of WO2017058892) in any combination, 244N, 246Q, 248R, 249E, 250I, 251K, 252S, 253G, 254S, 255V, 256D, 263Y, 377E, 378N, 453L, 456R, 532Q, 533P, 535N, 536P, 537G, 538T, 539T, 540A, 541T, 542Y, 543L, 546N, 653V, 654P, 656S, 697Q, 698F, 704D, 705S, 706T, 707G, 708E, 709Y and/or 710R of AAV5 (SEQ ID NO:5 of WO2017058892) in any combination, 248R, 316V, 317Q, 318D, 319S, 443N, 530N, 531S, 532Q 533P, 534A, 535N, 540A, 541 T, 542Y, 543L, 545G, 546N, 697Q, 704D, 706T, 708E, 709Y and/or 710R of AAV5 (SEQ ID NO: 5 of WO2017058892) in any combination, 264S, 266G, 269N, 272H, 457Q, 588S and/or 589I of AAV6 (SEQ ID NO:6 WO2017058892) in any combination, 457T, 459N, 496G, 499N, 500N, 589Q, 590N and/or 592A of AAV8 (SEQ ID NO: 8 WO2017058892) in any combination, 451I, 452N, 453G, 454S, 455G, 456Q, 457N and/or 458Q of AAV9 (SEQ ID NO: 9 WO2017058892) in any combination.

In some embodiments, the AAV may include a sequence of amino acids at positions 155, 156 and 157 of VP1 or at positions 17, 18, 19 and 20 of VP2, as described in International Publication No. WO 2017066764, the contents of which are herein incorporated by reference in their entirety. The sequences of amino acid may be, but not limited to, N—S—S, S—X—S, S—S—Y, N—X—S, N—S—Y, S—X—Y and N—X—Y, where N, X and Y are, but not limited to, independently non-serine, or non-threonine amino acids, wherein the AAV may be, but not limited to AAV1, AAV2, AAV3, AAV4, AAV5, AAV6, AAV7, AAV8, AAV9, AAV10, AAV11 and AAV12. In some embodiments, the AAV may include a deletion of at least one amino acid at positions 156, 157 or 158 of VP1 or at positions 19, 20 or 21 of VP2, wherein the AAV may be, but not limited to AAV1, AAV2, AAV3, AAV4, AAV5, AAV6, AAV7, AAV8, AAV9, AAV10, AAV11 and AAV12.

In one embodiment, the AAV serotype may be as described in Jackson et al (Frontiers in Molecular Neuroscience 9:154 (2016)), the contents of which are herein incorporated by reference in their entirety. In some embodiments, the AAV serotype is PHP.B or AAV9. In some embodiments, the AAV serotype is paired with a synapsin promoter to enhance neuronal transduction, as compared to when more ubiquitous promoters are used (i.e., CBA or CMV).

In one embodiment, peptides for inclusion in an AAV serotype may be identified by isolating human splenocytes, restimulating the splenocytes in vitro using individual peptides spanning the amino acid sequence of the AAV capsid protein, IFN-gamma ELISpot with the individual peptides used for the in vitro restimulation, bioinformatics analysis to determine the given allele restriction of 15-mers identified by IFN-gamma ELISpot, identification of candidate reactive 9-mer epitopes for a given allele, synthesis candidate 9-mers, second IFN-gamma ELISpot screening of splenocytes from subjects carrying the specific alleles to which identified AAV epitopes are predicted to bind, determine the AAV capsid-reactive CD8+ T cell epitopes and determine the frequency of subjects reacting to a given AAV epitope.

AAV particles comprising a modulatory polynucleotide encoding the siRNA molecules may be prepared or derived from various serotypes of AAVs, including, but not limited to, AAV1, AAV2, AAV3, AAV4, AAV5, AAV6, AAV7, AAV8, AAV9, AAV9.47, AAV9(hu14), AAV10, AAV11, AAV12, AAVrh8, AAVrh10, AAV-DJ8 and AAV-DJ. In some cases, different serotypes of AAVs may be mixed together or with other types of viruses to produce chimeric AAV particles. As a non-limiting example, the AAV particle is derived from the AAV9 serotype.

Viral Genome

In one embodiment, as shown in an AAV particle comprises a viral genome with a payload region.

In one embodiment, the viral genome may comprise the components as shown in FIG. 1. The payload region 110 is located within the viral genome 100. At the 5' and/or the 3' end of the viral genome 100 there may be at least one inverted terminal repeat (ITR) 120. Between the 5' ITR 120 and the payload region 110, there may be a promoter region 130. In one embodiment, the payload region may comprise at least one modulatory polynucleotide.

Figure 2:
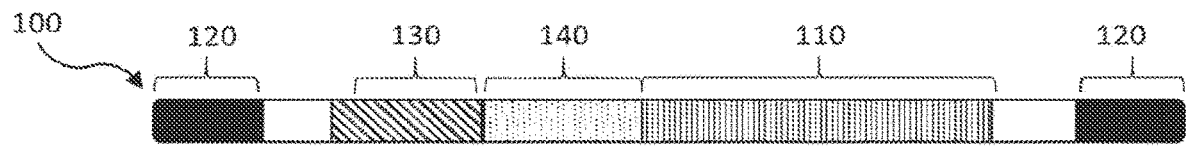
FIG. 2 is a schematic of a viral genome of the invention.

In one embodiment, the viral genome 100 may comprise the components as shown in FIG. 2. The payload region 110 is located within the viral genome 100. At the 5' and/or the 3' end of the viral genome 100 there may be at least one inverted terminal repeat (ITR) 120. Between the 5' ITR 120 and the payload region 110, there may be a promoter region 130. Between the promoter region 130 and the payload region 110, there may be an intron region 140. In one embodiment, the payload region may comprise at least one modulatory polynucleotide.

Figure 3:
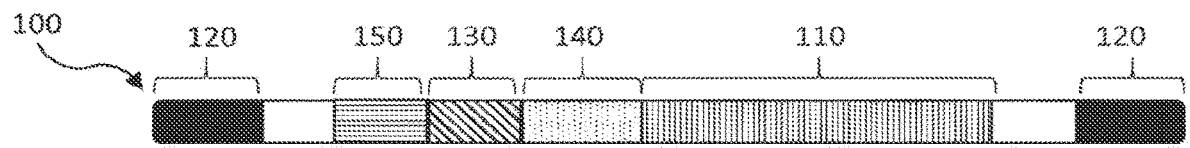
FIG. 3 is a schematic of a viral genome of the invention.

In one embodiment, the viral genome 100 may comprise the components as shown in FIG. 3. At the 5' and/or the 3' end of the viral genome 100 there may be at least one inverted terminal repeat (ITR) 120. Within the viral genome 100, there may be an enhancer region 150, a promoter region 130, an intron region 140, and a payload region 110. In one embodiment, the payload region may comprise at least one modulatory polynucleotide.

Figure 4:
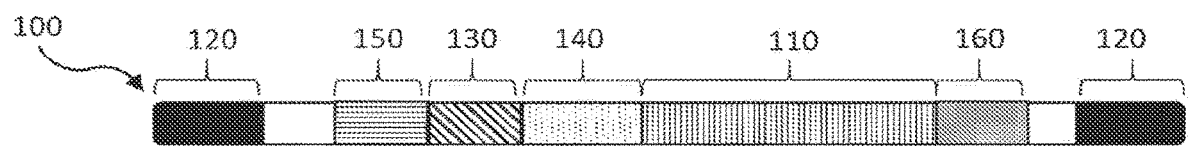
FIG. 4 is a schematic of a viral genome of the invention.

In one embodiment, the viral genome 100 may comprise the components as shown in FIG. 4. At the 5' and/or the 3' end of the viral genome 100 there may be at least one inverted terminal repeat (ITR) 120. Within the viral genome 100, there may be an enhancer region 150, a promoter region 130, an intron region 140, a payload region 110, and a polyadenylation signal sequence region 160. In one embodiment, the payload region may comprise at least one modulatory polynucleotide.

Figure 5:
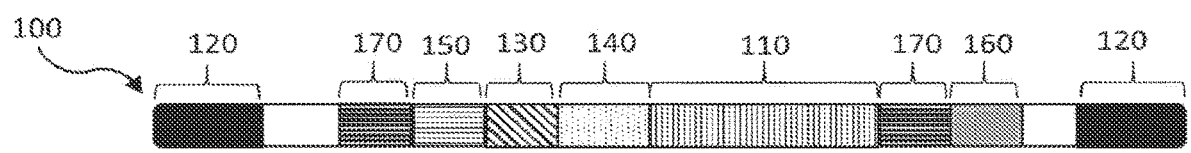
FIG. 5 is a schematic of a viral genome of the invention.

In one embodiment, the viral genome 100 may comprise the components as shown in FIG. 5. At the 5' and/or the 3' end of the viral genome 100 there may be at least one inverted terminal repeat (ITR) 120. Within the viral genome 100, there may be at least one MCS region 170, an enhancer region 150, a promoter region 130, an intron region 140, a payload region 110, and a polyadenylation signal sequence region 160. In one embodiment, the payload region may comprise at least one modulatory polynucleotide.

Figure 6:
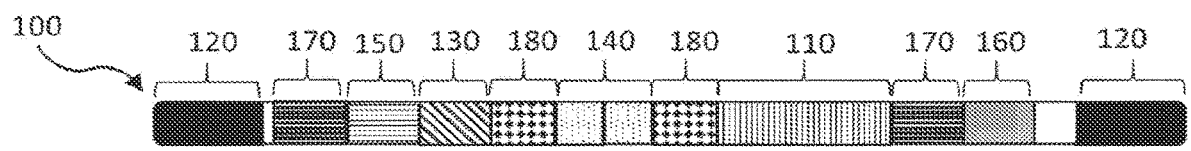
FIG. 6 is a schematic of a viral genome of the invention.

In one embodiment, the viral genome 100 may comprise the components as shown in FIG. 6. At the 5' and/or the 3' end of the viral genome 100 there may be at least one inverted terminal repeat (ITR) 120. Within the viral genome 100, there may be at least one MCS region 170, an enhancer region 150, a promoter region 130, at least one exon region 180, at least one intron region 140, a payload region 110, and a polyadenylation signal sequence region 160. In one embodiment, the payload region may comprise at least one modulatory polynucleotide.

Figure 7:
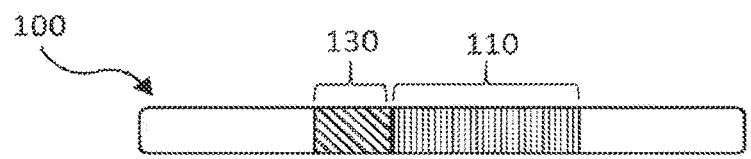
FIG. 7 is a schematic of a viral genome of the invention.
Figure 8:
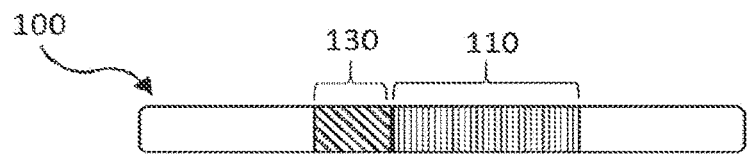
FIG. 8 is a schematic of a viral genome of the invention.

In one embodiment, the viral genome 100 may comprise the components as shown in FIGS. 7 and 8. Within the viral genome 100, there may be at least one promoter region 130, and a payload region 110. In one embodiment, the payload region may comprise at least one modulatory polynucleotide.

Figure 9:
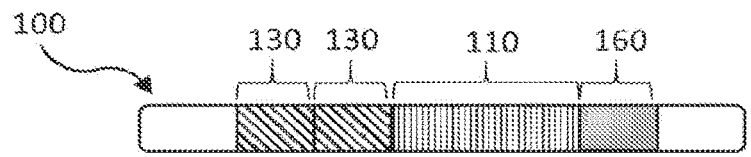
FIG. 9 is a schematic of a viral genome of the invention.

In one embodiment, the viral genome 100 may comprise the components as shown in FIG. 9. Within the viral genome 100, there may be at least one promoter region 130, a payload region 110, and a polyadenylation signal sequence region 160. In one embodiment, the payload region may comprise at least one modulatory polynucleotide.

Viral Genome Size

In one embodiment, the viral genome which comprises a payload described herein, may be single stranded or double stranded viral genome. The size of the viral genome may be small, medium, large or the maximum size. Additionally, the viral genome may comprise a promoter and a polyA tail.

In one embodiment, the viral genome which comprises a payload described herein, may be a small single stranded viral genome. A small single stranded viral genome may be 2.7 to 3.5 kb in size such as about 2.7, 2.8, 2.9, 3.0, 3.1, 3.2, 3.3, 3.4, and 3.5 kb in size. As a non-limiting example, the small single stranded viral genome may be 3.2 kb in size. Additionally, the viral genome may comprise a promoter and a polyA tail.

In one embodiment, the viral genome which comprises a payload described herein, may be a small double stranded viral genome. A small double stranded viral genome may be 1.3 to 1.7 kb in size such as about 1.3, 1.4, 1.5, 1.6, and 1.7 kb in size. As a non-limiting example, the small double stranded viral genome may be 1.6 kb in size. Additionally, the viral genome may comprise a promoter and a polyA tail.

In one embodiment, the viral genome which comprises a payload described herein, may a medium single stranded viral genome. A medium single stranded viral genome may be 3.6 to 4.3 kb in size such as about 3.6, 3.7, 3.8, 3.9, 4.0, 4.1, 4.2 and 4.3 kb in size. As a non-limiting example, the medium single stranded viral genome may be 4.0 kb in size. Additionally, the viral genome may comprise a promoter and a polyA tail.

In one embodiment, the viral genome which comprises a payload described herein, may be a medium double stranded viral genome. A medium double stranded viral genome may be 1.8 to 2.1 kb in size such as about 1.8, 1.9, 2.0, and 2.1 kb in size. As a non-limiting example, the medium double stranded viral genome may be 2.0 kb in size. Additionally, the viral genome may comprise a promoter and a polyA tail.

In one embodiment, the viral genome which comprises a payload described herein, may be a large single stranded viral genome. A large single stranded viral genome may be 4.4 to 6.0 kb in size such as about 4.4, 4.5, 4.6, 4.7, 4.8, 4.9, 5.0, 5.1, 5.2, 5.3, 5.4, 5.5, 5.6, 5.7, 5.8, 5.9 and 6.0 kb in size. As a non-limiting example, the large single stranded viral genome may be 4.7 kb in size. As another non-limiting example, the large single stranded viral genome may be 4.8 kb in size. As yet another non-limiting example, the large single stranded viral genome may be 6.0 kb in size. Additionally, the viral genome may comprise a promoter and a polyA tail.

In one embodiment, the viral genome which comprises a payload described herein, may be a large double stranded viral genome. A large double stranded viral genome may be 2.2 to 3.0 kb in size such as about 2.2, 2.3, 2.4, 2.5, 2.6, 2.7, 2.8, 2.9 and 3.0 kb in size. As a non-limiting example, the large double stranded viral genome may be 2.4 kb in size. Additionally, the viral genome may comprise a promoter and a polyA tail.

Viral Genome Component: Inverted Terminal Repeats (ITRs)

The AAV particles of the present invention comprise a viral genome with at least one ITR region and a payload region. In one embodiment the viral genome has two ITRs. These two ITRs flank the payload region at the 5' and 3' ends. The ITRs function as origins of replication comprising recognition sites for replication. ITRs comprise sequence regions which can be complementary and symmetrically arranged. ITRs incorporated into viral genomes of the invention may be comprised of naturally occurring polynucleotide sequences or recombinantly derived polynucleotide sequences.

The ITRs may be derived from the same serotype as the capsid, selected from any of the serotypes listed in Table 1, or a derivative thereof. The ITR may be of a different serotype from the capsid. In one embodiment the AAV particle has more than one ITR. In a non-limiting example, the AAV particle has a viral genome comprising two ITRs. In one embodiment the ITRs are of the same serotype as one another. In another embodiment the ITRs are of different serotypes. Non-limiting examples include zero, one or both of the ITRs having the same serotype as the capsid. In one embodiment both ITRs of the viral genome of the AAV particle are AAV2 ITRs.

Independently, each ITR may be about 100 to about 150 nucleotides in length. An ITR may be about 100-105 nucleotides in length, 106-110 nucleotides in length, 111-115 nucleotides in length, 116-120 nucleotides in length, 121-125 nucleotides in length, 126-130 nucleotides in length, 131-135 nucleotides in length, 136-140 nucleotides in length, 141-145 nucleotides in length or 146-150 nucleotides in length. In one embodiment the ITRs are 140-142 nucleotides in length. Non limiting examples of ITR length are 102, 140, 141, 142, 145 nucleotides in length, and those having at least 95% identity thereto.

In one embodiment, the AAV particle comprises a nucleic acid sequence encoding an siRNA molecule which may be located near the 5' end of the flip ITR in an expression vector. In another embodiment, the AAV particle comprises a nucleic acid sequence encoding an siRNA molecule may be located near the 3' end of the flip ITR in an expression vector. In yet another embodiment, the AAV particle comprises a nucleic acid sequence encoding an siRNA molecule may be located near the 5' end of the flop ITR in an expression vector. In yet another embodiment, the AAV particle comprises a nucleic acid sequence encoding an siRNA molecule may be located near the 3' end of the flop ITR in an expression vector. In one embodiment, the AAV particle comprises a nucleic acid sequence encoding an siRNA molecule may be located between the 5' end of the flip ITR and the 3' end of the flop ITR in an expression vector. In one embodiment, the AAV particle comprises a nucleic acid sequence encoding an siRNA molecule may be located between (e.g., half-way between the 5' end of the flip ITR and 3' end of the flop ITR or the 3' end of the flop ITR and the 5' end of the flip ITR), the 3' end of the flip ITR and the 5' end of the flip ITR in an expression vector. As a non-limiting example, the AAV particle comprises a nucleic acid sequence encoding an siRNA molecule may be located within 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more than 30 nucleotides downstream from the 5' or 3' end of an ITR (e.g., Flip or Flop ITR) in an expression vector. As a non-limiting example, the AAV particle comprises a nucleic acid sequence encoding an siRNA molecule may be located within 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more than 30 nucleotides upstream from the 5' or 3' end of an ITR (e.g., Flip or Flop ITR) in an expression vector. As another non-limiting example, the AAV particle comprises a nucleic acid sequence encoding an siRNA molecule may be located within 1-5, 1-10, 1-15, 1-20, 1-25, 1-30, 5-10, 5-15, 5-20, 5-25, 5-30, 10-15, 10-20, 10-25, 10-30, 15-20, 15-25, 15-30, 20-25, 20-30 or 25-30 nucleotides downstream from the 5' or 3' end of an ITR (e.g., Flip or Flop ITR) in an expression vector. As another non-limiting example, the AAV particle comprises a nucleic acid sequence encoding an siRNA molecule may be located within 1-5, 1-10, 1-15, 1-20, 1-25, 1-30, 5-10, 5-15, 5-20, 5-25, 5-30, 10-15, 10-20, 10-25, 10-30, 15-20, 15-25, 15-30, 20-25, 20-30 or 25-30 upstream from the 5' or 3' end of an ITR (e.g., Flip or Flop ITR) in an expression vector. As a non-limiting example, the AAV particle comprises a nucleic acid sequence encoding an siRNA molecule may be located within the first 1%, 2%, 3%, 4%, 5%, 6%, 7%, 8%, 9%, 10%, 15%, 20%, 25% or more than 25% of the nucleotides upstream from the 5' or 3' end of an ITR (e.g., Flip or Flop ITR) in an expression vector. As another non-limiting example, the AAV particle comprises a nucleic acid sequence encoding an siRNA molecule may be located with the first 1-5%, 1-10%, 1-15%, 1-20%, 1-25%, 5-10%, 5-15%, 5-20%, 5-25%, 10-15%, 10-20%, 10-25%, 15-20%, 15-25%, or 20-25% downstream from the 5' or 3' end of an ITR (e.g., Flip or Flop ITR) in an expression vector.

Viral Genome Component: Promoters

In one embodiment, the payload region of the viral genome comprises at least one element to enhance the transgene target specificity and expression (See e.g., Powell et al. Viral Expression Cassette Elements to Enhance Transgene Target Specificity and Expression in Gene Therapy, 2015; the contents of which are herein incorporated by reference in its entirety). Non-limiting examples of elements to enhance the transgene target specificity and expression include promoters, endogenous miRNAs, post-transcriptional regulatory elements (PREs), polyadenylation (PolyA) signal sequences and upstream enhancers (USEs), CMV enhancers and introns.

A person skilled in the art may recognize that expression of the polypeptides of the invention in a target cell may require a specific promoter, including but not limited to, a promoter that is species specific, inducible, tissue-specific, or cell cycle-specific (Parr et al., Nat. Med. 3:1145-9 (1997); the contents of which are herein incorporated by reference in their entirety).

In one embodiment, the promoter is deemed to be efficient when it drives expression of the polypeptide(s) encoded in the payload region of the viral genome of the AAV particle.

In one embodiment, the promoter is a promoter deemed to be efficient to drive the expression of the modulatory polynucleotide.

In one embodiment, the promoter is a promoter deemed to be efficient when it drives expression in the cell being targeted.

In one embodiment, the promoter drives expression of the payload for a period of time in targeted tissues. Expression driven by a promoter may be for a period of 1 hour, 2, hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 2 days, 3 days, 4 days, 5 days, 6 days, 1 week, 8 days, 9 days, 10 days, 11 days, 12 days, 13 days, 2 weeks, 15 days, 16 days, 17 days, 18 days, 19 days, 20 days, 3 weeks, 22 days, 23 days, 24 days, 25 days, 26 days, 27 days, 28 days, 29 days, 30 days, 31 days, 1 month, 2 months, 3 months, 4 months, 5 months, 6 months, 7 months, 8 months, 9 months, 10 months, 11 months, 1 year, 13 months, 14 months, 15 months, 16 months, 17 months, 18 months, 19 months, 20 months, 21 months, 22 months, 23 months, 2 years, 3 years, 4 years, 5 years, 6 years, 7 years, 8 years, 9 years, 10 years or more than 10 years. Expression may be for 1-5 hours, 1-12 hours, 1-2 days, 1-5 days, 1-2 weeks, 1-3 weeks, 1-4 weeks, 1-2 months, 1-4 months, 1-6 months, 2-6 months, 3-6 months, 3-9 months, 4-8 months, 6-12 months, 1-2 years, 1-5 years, 2-5 years, 3-6 years, 3-8 years, 4-8 years or 5-10 years.

In one embodiment, the promoter drives expression of the payload for at least 1 month, 2 months, 3 months, 4 months, 5 months, 6 months, 7 months, 8 months, 9 months, 10 months, 11 months, 1 year, 2 years, 3 years 4 years, 5 years, 6 years, 7 years, 8 years, 9 years, 10 years, 11 years, 12 years, 13 years, 14 years, 15 years, 16 years, 17 years, 18 years, 19 years, 20 years, 21 years, 22 years, 23 years, 24 years, 25 years, 26 years, 27 years, 28 years, 29 years, 30 years, 31 years, 32 years, 33 years, 34 years, 35 years, 36 years, 37 years, 38 years, 39 years, 40 years, 41 years, 42 years, 43 years, 44 years, 45 years, 46 years, 47 years, 48 years, 49 years, 50 years, 55 years, 60 years, 65 years, or more than 65 years.

Promoters may be naturally occurring or non-naturally occurring. Non-limiting examples of promoters include viral promoters, plant promoters and mammalian promoters. In some embodiments, the promoters may be human promoters. In some embodiments, the promoter may be truncated.

Promoters which drive or promote expression in most tissues include, but are not limited to, human elongation factor 1α-subunit (EF1α), cytomegalovirus (CMV) immediate-early enhancer and/or promoter, chicken β-actin (CBA) and its derivative CAG, β glucuronidase (GUSB), or ubiquitin C (UBC). Tissue-specific expression elements can be used to restrict expression to certain cell types such as, but not limited to, muscle specific promoters, B cell promoters, monocyte promoters, leukocyte promoters, macrophage promoters, pancreatic acinar cell promoters, endothelial cell promoters, lung tissue promoters, astrocyte promoters, or nervous system promoters which can be used to restrict expression to neurons, astrocytes, or oligodendrocytes.

Non-limiting examples of muscle-specific promoters include mammalian muscle creatine kinase (MCK) promoter, mammalian desmin (DES) promoter, mammalian troponin I (TNNI2) promoter, and mammalian skeletal alpha-actin (ASKA) promoter (see, e.g. U.S. Patent Publication US 20110212529, the contents of which are herein incorporated by reference in their entirety)

Non-limiting examples of tissue-specific expression elements for neurons include neuron-specific enolase (NSE), platelet-derived growth factor (PDGF), platelet-derived growth factor B-chain (PDGF-3), synapsin (Syn), methyl-CpG binding protein 2 (MeCP2), $Ca^{2+}$/calmodulin-dependent protein kinase II (CaMKII), metabotropic glutamate receptor 2 (mGluR2), neurofilament light (NFL) or heavy (NFH), β-globin minigene nβ2, preproenkephalin (PPE), enkephalin (Enk) and excitatory amino acid transporter 2 (EAAT2) promoters. Non-limiting examples of tissue-specific expression elements for astrocytes include glial fibrillary acidic protein (GFAP) and EAAT2 promoters. A non-limiting example of a tissue-specific expression element for oligodendrocytes includes the myelin basic protein (MBP) promoter.

In one embodiment, the promoter may be less than 1 kb. The promoter may have a length of 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800 or more than 800 nucleotides. The promoter may have a length between 200-300, 200-400, 200-500, 200-600, 200-700, 200-800, 300-400, 300-500, 300-600, 300-700, 300-800, 400-500, 400-600, 400-700, 400-800, 500-600, 500-700, 500-800, 600-700, 600-800 or 700-800.

In one embodiment, the promoter may be a combination of two or more components of the same or different starting or parental promoters such as, but not limited to, CMV and CBA. Each component may have a length of 200, 210, 220, 230, 240, 250, 260, 270, 280, 290, 300, 310, 320, 330, 340, 350, 360, 370, 380, 381, 382, 383, 384, 385, 386, 387, 388, 389, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800 or more than 800. Each component may have a length between 200-300, 200-400, 200-500, 200-600, 200-700, 200-800, 300-400, 300-500, 300-600, 300-700, 300-800, 400-500, 400-600, 400-700, 400-800, 500-600, 500-700, 500-800, 600-700, 600-800 or 700-800. In one embodiment, the promoter is a combination of a 382 nucleotide CMV-enhancer sequence and a 260 nucleotide CBA-promoter sequence.

In one embodiment, the viral genome comprises a ubiquitous promoter. Non-limiting examples of ubiquitous promoters include CMV, CBA (including derivatives CAG, CBh, etc.), EF-1α, PGK, UBC, GUSB (hGBp), and UCOE (promoter of HNRPA2B1-CBX3).

Yu et al. (Molecular Pain 2011, 7:63; the contents of which are herein incorporated by reference in their entirety) evaluated the expression of eGFP under the CAG, EF1α, PGK and UBC promoters in rat DRG cells and primary DRG cells using lentiviral vectors and found that UBC showed weaker expression than the other 3 promoters and only 10-12% glial expression was seen for all promoters. Soderblom et al. (E. Neuro 2015; the contents of which are herein incorporated by reference in its entirety) evaluated the expression of eGFP in AAV8 with CMV and UBC promoters and AAV2 with the CMV promoter after injection in the motor cortex. Intranasal administration of a plasmid containing a UBC or EF1α promoter showed a sustained airway expression greater than the expression with the CMV promoter (See e.g., Gill et al., Gene Therapy 2001, Vol. 8, 1539-1546, the contents of which are herein incorporated by reference in their entirety). Husain et al. (Gene Therapy 2009; the contents of which are herein incorporated by reference in its entirety) evaluated an HOH construct with a hGUSB promoter, a HSV-1LAT promoter and an NSE promoter and found that the HPH construct showed weaker expression than NSE in mouse brain. Passini and Wolfe (J. Virol. 2001, 12382-12392, the contents of which are herein incorporated by reference in its entirety) evaluated the long-term effects of the HPH vector following an intraventricular injection in neonatal mice and found that there was sustained expression for at least 1 year. Low expression in all brain regions was found by Xu et al. (Gene Therapy 2001, 8, 1323-1332; the contents of which are herein incorporated by reference in their entirety) when NFL and NFH promoters were used as compared to the CMV-lacZ, CMV-luc, EF, GFAP, hENK, nAChR, PPE, PPE+wpre, NSE (0.3 kb), NSE (1.8 kb) and NSE (1.8 kb+wpre). Xu et al. found that the promoter activity in descending order was NSE (1.8 kb), EF, NSE (0.3 kb), GFAP, CMV, hENK, PPE, NFL and NFH. NFL is a 650 nucleotide promoter and NFH is a 920 nucleotide promoter which are both absent in the liver but NFH is abundant in the sensory proprioceptive neurons, brain and spinal cord and NFH is present in the heart. Scn8a is a 470 nucleotide promoter which expresses throughout the DRG, spinal cord and brain with particularly high expression seen in the hippocampal neurons and cerebellar Purkinje cells, cortex, thalamus and hypothalamus (See e.g., Drews et al. *Identification of evolutionary conserved, functional noncoding elements m the promoter region of the sodium channel gene SCN8A*. Mamm Genome (2007) 18:723-731; and Raymond et al. *Expression of Alternatively Spliced Sodium Channel α-subunit genes*. Journal of Biological Chemistry (2004) 279(44) 46234-46241; the contents of each of which are herein incorporated by reference in their entireties).

Any of promoters taught by the aforementioned Yu, Soderblom, Gill. Husain, Passini, Xu, Drews or Raymond may be used in the present inventions.

In one embodiment, the promoter is not cell specific.

In one embodiment, the promoter is an ubiquitin c (UBC) promoter. The UBC promoter may have a size of 300-350 nucleotides. As a non-limiting example, the UBC promoter is 332 nucleotides.

In one embodiment, the promoter is a f-glucuronidase (GUSB) promoter. The GUSB promoter may have a size of 350-400 nucleotides. As a non-limiting example, the GUSB promoter is 378 nucleotides.

In one embodiment, the promoter is a neurofilament light (NFL) promoter. The NFL promoter may have a size of 600-700 nucleotides. As a non-limiting example, the NFL promoter is 650 nucleotides. As a non-limiting example, the construct may be AAV-promoter-CMV/globin intron-modulatory polynucleotide-RBG, where the AAV may be self-complementary and the AAV may be the DJ serotype.

In one embodiment, the promoter is a neurofilament heavy (NFH) promoter. The NFH promoter may have a size of 900-950 nucleotides. As a non-limiting example, the NFH promoter is 920 nucleotides. As a non-limiting example, the construct may be AAV-promoter-CMV/globin intron-modulatory polynucleotide-RBG, where the AAV may be self-complementary and the AAV may be the DJ serotype.

In one embodiment, the promoter is a scn8a promoter. The scn8a promoter may have a size of 450-500 nucleotides. As a non-limiting example, the scn8a promoter is 470 nucleotides. As a non-limiting example, the construct may be AAV-promoter-CMV/globin intron-modulatory polynucleotide-RBG, where the AAV may be self-complementary and the AAV may be the DJ serotype In one embodiment, the viral genome comprises a Pol III promoter.

In one embodiment, the viral genome comprises a P1 promoter.

In one embodiment, the viral genome comprises a FXN promoter.

In one embodiment, the promoter is a phosphoglycerate kinase 1 (PGK) promoter.

In one embodiment, the promoter is a chicken β-actin (CBA) promoter.

In one embodiment, the promoter is a CAG promoter which is a construct comprising the cytomegalovirus (CMV) enhancer fused to the chicken beta-actin (CBA) promoter.

In one embodiment, the promoter is a cytomegalovirus (CMV) promoter.

In one embodiment, the viral genome comprises a H1 promoter.

In one embodiment, the viral genome comprises a U6 promoter.

In one embodiment, the promoter is a liver or a skeletal muscle promoter. Non-limiting examples of liver promoters include human α-1-antitrypsin (hAAT) and thyroxine binding globulin (TBG). Non-limiting examples of skeletal muscle promoters include Desmin, MCK or synthetic C5-12.

In one embodiment, the promoter is a RNA pol III promoter. As a non-limiting example, the RNA pol III promoter is U6. As a non-limiting example, the RNA pol III promoter is H1.

In one embodiment, the viral genome comprises two promoters. As a non-limiting example, the promoters are an EF1α promoter and a CMV promoter.

In one embodiment, the viral genome comprises an enhancer element, a promoter and/or a 5'UTR intron. The enhancer element, also referred to herein as an "enhancer," may be, but is not limited to, a CMV enhancer, the promoter may be, but is not limited to, a CMV, CBA, UBC, GUSB, NSE, Synapsin, MeCP2, and GFAP promoter and the 5'UTR/intron may be, but is not limited to, SV40, and CBA-MVM. As a non-limiting example, the enhancer, promoter and/or intron used in combination may be: (1) CMV enhancer, CMV promoter, SV40 5'UTR intron; (2) CMV enhancer, CBA promoter, SV 40 5'UTR intron; (3) CMV enhancer, CBA promoter, CBA-MVM 5'UTR intron; (4) UBC promoter; (5) GUSB promoter; (6) NSE promoter; (7) Synapsin promoter; (8) MeCP2 promoter, (9) GFAP promoter, (10) H1 promoter; and (11) U6 promoter.

In one embodiment, the viral genome comprises an engineered promoter.

In another embodiment the viral genome comprises a promoter from a naturally expressed protein.

Viral Genome Component: Untranslated Regions (UTRs)

By definition, wild type untranslated regions (UTRs) of a gene are transcribed but not translated. Generally, the 5' UTR starts at the transcription start site and ends at the start codon and the 3' UTR starts immediately following the stop codon and continues until the termination signal for transcription.

Features typically found in abundantly expressed genes of specific target organs may be engineered into UTRs to enhance the stability and protein production. As a non-limiting example, a 5' UTR from mRNA normally expressed in the liver (e.g., albumin, serum amyloid A, Apolipoprotein A/B/E, transferrin, alpha fetoprotein, erythropoietin, or Factor VIII) may be used in the viral genomes of the AAV particles of the invention to enhance expression in hepatic cell lines or liver.

While not wishing to be bound by theory, wild-type 5' untranslated regions (UTRs) include features which play roles in translation initiation. Kozak sequences, which are commonly known to be involved in the process by which the ribosome initiates translation of many genes, are usually included in 5' UTRs. Kozak sequences have the consensus CCR(A/G)CCAUGG, where R is a purine (adenine or guanine) three bases upstream of the start codon (ATG), which is followed by another 'G'.

In one embodiment, the 5'UTR in the viral genome includes a Kozak sequence.

In one embodiment, the 5'UTR in the viral genome does not include a Kozak sequence.

While not wishing to be bound by theory, wild-type 3' UTRs are known to have stretches of Adenosines and Uridines embedded therein. These AU rich signatures are particularly prevalent in genes with high rates of turnover. Based on their sequence features and functional properties, the AU rich elements (AREs) can be separated into three classes (Chen et al, 1995, the contents of which are herein incorporated by reference in its entirety): Class I AREs, such as, but not limited to, c-Myc and MyoD, contain several dispersed copies of an AUUUA motif within U-rich regions. Class II AREs, such as, but not limited to, GM-CSF and TNF-α, possess two or more overlapping UUAUUUA(U/A)(U/A) nonamers. Class III ARES, such as, but not limited to, c-Jun and Myogenin, are less well defined. These U rich regions do not contain an AUUUA motif. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of polynucleotides. When engineering specific polynucleotides, e.g., payload regions of viral genomes, one or more copies of an ARE can be introduced to make polynucleotides less stable and thereby curtail translation and decrease production of the resultant protein. Likewise, AREs can be identified and removed or mutated to increase the intracellular stability and thus increase translation and production of the resultant protein.

In one embodiment, the 3' UTR of the viral genome may include an oligo(dT) sequence for templated addition of a poly-A tail.

In one embodiment, the viral genome may include at least one miRNA seed, binding site or full sequence, microRNAs (or miRNA or miR) are 19-25 nucleotide noncoding RNAs that bind to the sites of nucleic acid targets and down-regulate gene expression either by reducing nucleic acid molecule stability or by inhibiting translation. A microRNA sequence comprises a "seed" region, i.e., a sequence in the region of positions 2-8 of the mature microRNA, which sequence has perfect Watson-Crick complementarity to the miRNA target sequence of the nucleic acid.

In one embodiment, the viral genome may be engineered to include, alter or remove at least one miRNA binding site, sequence or seed region.

Any UTR from any gene known in the art may be incorporated into the viral genome of the AAV particle. These UTRs, or portions thereof, may be placed in the same orientation as in the gene from which they were selected or they may be altered in orientation or location. In one embodiment, the UTR used in the viral genome of the AAV particle may be inverted, shortened, lengthened, made with one or more other 5' UTRs or 3' UTRs known in the art. As used herein, the term "altered" as it relates to a UTR, means that the UTR has been changed in some way in relation to a reference sequence. For example, a 3' or 5' UTR may be altered relative to a wild type or native UTR by the change in orientation or location as taught above or may be altered by the inclusion of additional nucleotides, deletion of nucleotides, swapping or transposition of nucleotides.

In one embodiment, the viral genome of the AAV particle comprises at least one artificial UTRs which is not a variant of a wild type UTR In one embodiment, the viral genome of the AAV particle comprises UTRs which have been selected from a family of transcripts whose proteins share a common function, structure, feature or property.

Viral Genome Component: Polyadenylation Sequence

In one embodiment, the viral genome of the AAV particles of the present invention comprise at least one polyadenylation sequence. The viral genome of the AAV particle may comprise a polyadenylation sequence between the 3' end of the payload coding sequence and the 5' end of the 3'ITR.

In one embodiment, the polyadenylation sequence or "polyA sequence" may range from absent to about 500 nucleotides in length. The polyadenylation sequence may be, but is not limited to, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, and 500 nucleotides in length.

In one embodiment, the polyadenylation sequence is 50-100 nucleotides in length.

In one embodiment, the polyadenylation sequence is 50-150 nucleotides in length.

In one embodiment, the polyadenylation sequence is 50-160 nucleotides in length.

In one embodiment, the polyadenylation sequence is 50-200 nucleotides in length.

In one embodiment, the polyadenylation sequence is 60-100 nucleotides in length.

In one embodiment, the polyadenylation sequence is 60-150 nucleotides in length.

In one embodiment, the polyadenylation sequence is 60-160 nucleotides in length.

In one embodiment, the polyadenylation sequence is 60-200 nucleotides in length.

In one embodiment, the polyadenylation sequence is 70-100 nucleotides in length.

In one embodiment, the polyadenylation sequence is 70-150 nucleotides in length.

In one embodiment, the polyadenylation sequence is 70-160 nucleotides in length.

In one embodiment, the polyadenylation sequence is 70-200 nucleotides in length.

In one embodiment, the polyadenylation sequence is 80-100 nucleotides in length.

In one embodiment, the polyadenylation sequence is 80-150 nucleotides in length.

In one embodiment, the polyadenylation sequence is 80-160 nucleotides in length.

In one embodiment, the polyadenylation sequence is 80-200 nucleotides in length.

In one embodiment, the polyadenylation sequence is 90-100 nucleotides in length.

In one embodiment, the polyadenylation sequence is 90-150 nucleotides in length.

In one embodiment, the polyadenylation sequence is 90-160 nucleotides in length.

In one embodiment, the polyadenylation sequence is 90-200 nucleotides in length.

In one embodiment, the AAV particle comprises a nucleic acid sequence encoding an siRNA molecule may be located upstream of the polyadenylation sequence in an expression vector. Further, the AAV particle comprises a nucleic acid sequence encoding an siRNA molecule may be located downstream of a promoter such as, but not limited to, CMV, U6, CAG, CBA or a CBA promoter with a SV40 intron or a human betaglobin intron in an expression vector. As a non-limiting example, the AAV particle comprises a nucleic acid sequence encoding an siRNA molecule may be located within 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more than 30 nucleotides downstream from the promoter and/or upstream of the polyadenylation sequence in an expression vector. As another non-limiting example, the AAV particle comprises a nucleic acid sequence encoding an siRNA molecule may be located within 1-5, 1-10, 1-15, 1-20, 1-25, 1-30, 5-10, 5-15, 5-20, 5-25, 5-30, 10-15, 10-20, 10-25, 10-30, 15-20, 15-25, 15-30, 20-25, 20-30 or 25-30 nucleotides downstream from the promoter and/or upstream of the polyadenylation sequence in an expression vector. As a non-limiting example, the AAV particle comprises a nucleic acid sequence encoding an siRNA molecule may be located within the first 1%, 2%, 3%, 4%, 5%, 6%, 7%, 8%, 9%, 10%, 15%, 20%, 25% or more than 25% of the nucleotides downstream from the promoter and/or upstream of the polyadenylation sequence in an expression vector. As another non-limiting example, the AAV particle comprises a nucleic acid sequence encoding an siRNA molecule may be located with the first 1-5%, 1-10%, 1-15%, 1-20%, 1-25%, 5-10%, 5-15%, 5-20%, 5-25%, 10-15%, 10-20%, 10-25%, 15-20%, 15-25%, or 20-25% downstream from the promoter and/or upstream of the polyadenylation sequence in an expression vector.

In one embodiment, the AAV particle comprises a rabbit globin polyadenylation (polyA) signal sequence.

In one embodiment, the AAV particle comprises a human growth hormone polyadenylation (polyA) signal sequence.

Viral Genome Component: Introns

In one embodiment, the payload region comprises at least one element to enhance the expression such as one or more introns or portions thereof. Non-limiting examples of introns include, MVM (67-97 bps), F.IX truncated intron 1 (300 bps), f-globin SD/immunoglobulin heavy chain splice acceptor (250 bps), adenovirus splice donor/immunoglobin splice acceptor (500 bps), SV40 late splice donor/splice acceptor (19S/16S) (180 bps) and hybrid adenovirus splice donor/IgG splice acceptor (230 bps).

In one embodiment, the intron or intron portion may be 100-500 nucleotides in length. The intron may have a length of 80, 90, 100, 110, 120, 130, 140, 150, 160, 170, 171, 172, 173, 174, 175, 176, 177, 178, 179, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490 or 500, The intron may have a length between 80-100, 80-120, 80-140, 80-160, 80-180, 80-200, 80-250, 80-300, 80-350, 80-400, 80-450, 80-500, 200-300, 200-400, 200-500, 300-400, 300-500, or 400-500.

In one embodiment, the AAV viral genome may comprise a promoter such as, but not limited to, CMV or U6. As a non-limiting example, the promoter for the AAV comprising the nucleic acid sequence for the siRNA molecules of the present invention is a CMV promoter. As another non-limiting example, the promoter for the AAV comprising the nucleic acid sequence for the siRNA molecules of the present invention is a U6 promoter.

In one embodiment, the AAV viral genome may comprise a CMV promoter.

In one embodiment, the AAV viral genome may comprise a U6 promoter.

In one embodiment, the AAV viral genome may comprise a CMV and a U6 promoter.

In one embodiment, the AAV viral genome may comprise a H1 promoter.

In one embodiment, the AAV viral genome may comprise a CBA promoter.

In one embodiment, the encoded siRNA molecule may be located downstream of a promoter in an expression vector such as, but not limited to, CMV, U6, H1, CBA, CAG, or a CBA promoter with an intron such as SV40 or others known in the art. Further, the encoded siRNA molecule may also be located upstream of the polyadenylation sequence in an expression vector. As a non-limiting example, the encoded siRNA molecule may be located within 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more than 30 nucleotides downstream from the promoter and/or upstream of the polyadenylation sequence in an expression vector. As another non-limiting example, the encoded siRNA molecule may be located within 1-5, 1-10, 1-15, 1-20, 1-25, 1-30, 5-10, 5-15, 5-20, 5-25, 5-30, 10-15, 10-20, 10-25, 10-30, 15-20, 15-25, 15-30, 20-25, 20-30 or 25-30 nucleotides downstream from the promoter and/or upstream of the polyadenylation sequence in an expression vector. As a non-limiting example, the encoded siRNA molecule may be located within the first 1%, 2%, 3%, 4%, 5%, 6%, 7%, 8%, 9%, 10%, 15%, 20%, 25% or more than 25% of the nucleotides downstream from the promoter and/or upstream of the polyadenylation sequence in an expression vector. As another non-limiting example, the encoded siRNA molecule may be located with the first 1-5%, 1-10%, 1-15%, 1-20%, 1-25%, 5-10%, 5-15%, 5-20%, 5-25%, 10-15%, 10-20%, 10-25%, 15-20%, 15-25%, or 20-25% downstream from the promoter and/or upstream of the polyadenylation sequence in an expression vector.

Viral Genome Component: Filler Sequence

In one embodiment, the viral genome comprises one or more filler sequences.

In one embodiment, the viral genome comprises one or more filler sequences in order to have the length of the viral genome be the optimal size for packaging. As a non-limiting example, the viral genome comprises at least one filler sequence in order to have the length of the viral genome be about 2.3 kb. As a non-limiting example, the viral genome comprises at least one filler sequence in order to have the length of the viral genome be about 4.6 kb.

In one embodiment, the viral genome comprises one or more filler sequences in order to reduce the likelihood that a hairpin structure of the vector genome (e.g., a modulatory polynucleotide described herein) may be read as an inverted terminal repeat (ITR) during expression and/or packaging. As a non-limiting example, the viral genome comprises at least one filler sequence in order to have the length of the viral genome be about 2.3 kb. As a non-limiting example, the viral genome comprises at least one filler sequence in order to have the length of the viral genome be about 4.6 kb In one embodiment, the viral genome is a single stranded (ss) viral genome and comprises one or more filler sequences which have a length about between 0.1 kb-3.8 kb, such as, but not limited to, 0.1 kb, 0.2 kb, 0.3 kb, 0.4 kb, 0.5 kb, 0.6 kb, 0.7 kb, 0.8 kb, 0.9 kb, 1 kb, 1.1 kb, 1.2 kb, 1.3 kb, 1.4 kb, 1.5 kb, 1.6 kb, 1.7 kb, 1.8 kb, 1.9 kb, 2 kb, 2.1 kb, 2.2 kb, 2.3 kb, 2.4 kb, 2.5 kb, 2.6 kb, 2.7 kb, 2.8 kb, 2.9 kb, 3 kb, 3.1 kb, 3.2 kb, 3.3 kb, 3.4 kb, 3.5 kb, 3.6 kb, 3.7 kb, or 3.8 kb. As a non-limiting example, the total length filler sequence in the vector genome is 3.1 kb. As a non-limiting example, the total length filler sequence in the vector genome is 2.7 kb. As a non-limiting example, the total length filler sequence in the vector genome is 0.8 kb. As a non-limiting example, the total length filler sequence in the vector genome is 0.4 kb. As a non-limiting example, the length of each filler sequence in the vector genome is 0.8 kb. As a non-limiting example, the length of each filler sequence in the vector genome is 0.4 kb.

In one embodiment, the viral genome is a self-complementary (sc) viral genome and comprises one or more filler sequences which have a length about between 0.1 kb-1.5 kb, such as, but not limited to, 0.1 kb, 0.2 kb, 0.3 kb, 0.4 kb, 0.5 kb, 0.6 kb, 0.7 kb, 0.8 kb, 0.9 kb, 1 kb, 1.1 kb, 1.2 kb, 1.3 kb, 1.4 kb, or 1.5 kb. As a non-limiting example, the total length filler sequence in the vector genome is 0.8 kb. As a non-limiting example, the total length filler sequence in the vector genome is 0.4 kb. As a non-limiting example, the length of each filler sequence in the vector genome is 0.8 kb. As a non-limiting example, the length of each filler sequence in the vector genome is 0.4 kb In one embodiment, the viral genome comprises any portion of a filler sequence. The viral genome may comprise 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, or 99% of a filler sequence.

In one embodiment, the viral genome is a single stranded (ss) viral genome and comprises one or more filler sequences in order to have the length of the viral genome be about 4.6 kb. As a non-limiting example, the viral genome comprises at least one filler sequence and the filler sequence is located 3' to the 5' ITR sequence. As a non-limiting example, the viral genome comprises at least one filler sequence and the filler sequence is located 5' to a promoter sequence. As a non-limiting example, the viral genome comprises at least one filler sequence and the filler sequence is located 3' to the polyadenylation signal sequence. As a non-limiting example, the viral genome comprises at least one filler sequence and the filler sequence is located 5' to the 3' ITR sequence. As a non-limiting example, the viral genome comprises at least one filler sequence, and the filler sequence is located between two intron sequences. As a non-limiting example, the viral genome comprises at least one filler sequence, and the filler sequence is located within an intron sequence. As a non-limiting example, the viral genome comprises two filler sequences, and the first filler sequence is located 3' to the 5' ITR sequence and the second filler sequence is located 3' to the polyadenylation signal sequence. As a non-limiting example, the viral genome comprises two filler sequences, and the first filler sequence is located 5' to a promoter sequence and the second filler sequence is located 3' to the polyadenylation signal sequence. As a non-limiting example, the viral genome comprises two filler sequences, and the first filler sequence is located 3' to the 5' ITR sequence and the second filler sequence is located 5' to the 5' ITR sequence.

In one embodiment, the viral genome is a self-complementary (sc) viral genome and comprises one or more filler sequences in order to have the length of the viral genome be about 2.3 kb. As a non-limiting example, the viral genome comprises at least one filler sequence and the filler sequence is located 3' to the 5' ITR sequence. As a non-limiting example, the viral genome comprises at least one filler sequence and the filler sequence is located 5' to a promoter sequence. As a non-limiting example, the viral genome comprises at least one filler sequence and the filler sequence is located 3' to the polyadenylation signal sequence. As a non-limiting example, the viral genome comprises at least one filler sequence and the filler sequence is located 5' to the 3' ITR sequence. As a non-limiting example, the viral genome comprises at least one filler sequence, and the filler sequence is located between two intron sequences. As a non-limiting example, the viral genome comprises at least one filler sequence, and the filler sequence is located within an intron sequence. As a non-limiting example, the viral genome comprises two filler sequences, and the first filler sequence is located 3' to the 5' ITR sequence and the second filler sequence is located 3' to the polyadenylation signal sequence. As a non-limiting example, the viral genome comprises two filler sequences, and the first filler sequence is located 5' to a promoter sequence and the second filler sequence is located 3' to the polyadenylation signal sequence. As a non-limiting example, the viral genome comprises two filler sequences, and the first filler sequence is located 3' to the 5' ITR sequence and the second filler sequence is located 5' to the 5' ITR sequence.

In one embodiment, the viral genome may comprise one or more filler sequences between one of more regions of the viral genome. In one embodiment, the filler region may be located before a region such as, but not limited to, a payload region, an inverted terminal repeat (ITR), a promoter region, an intron region, an enhancer region, a polyadenylation signal sequence region, a multiple cloning site (MCS) region, and/or an exon region. In one embodiment, the filler region may be located after a region such as, but not limited to, a payload region, an inverted terminal repeat (ITR), a promoter region, an intron region, an enhancer region, a polyadenylation signal sequence region, a multiple cloning site (MCS) region, and/or an exon region. In one embodiment, the filler region may be located before and after a region such as, but not limited to, a payload region, an inverted terminal repeat (ITR), a promoter region, an intron region, an enhancer region, a polyadenylation signal sequence region, a multiple cloning site (MCS) region, and/or an exon region.

In one embodiment, the viral genome may comprise one or more filler sequences which bifurcates at least one region of the viral genome. The bifurcated region of the viral genome may comprise 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, or 99% of the of the region to the 5' of the filler sequence region. As a non-limiting example, the filler sequence may bifurcate at least one region so that 10% of the region is located 5' to the filler sequence and 90% of the region is located 3' to the filler sequence. As a non-limiting example, the filler sequence may bifurcate at least one region so that 20% of the region is located 5' to the filler sequence and 80% of the region is located 3' to the filler sequence. As a non-limiting example, the filler sequence may bifurcate at least one region so that 30% of the region is located 5' to the filler sequence and 70% of the region is located 3' to the filler sequence. As a non-limiting example, the filler sequence may bifurcate at least one region so that 40% of the region is located 5' to the filler sequence and 60% of the region is located 3' to the filler sequence. As a non-limiting example, the filler sequence may bifurcate at least one region so that 50% of the region is located 5' to the filler sequence and 50% of the region is located 3' to the filler sequence. As a non-limiting example, the filler sequence may bifurcate at least one region so that 60% of the region is located 5' to the filler sequence and 40% of the region is located 3' to the filler sequence. As a non-limiting example, the filler sequence may bifurcate at least one region so that 70% of the region is located 5' to the filler sequence and 30% of the region is located 3' to the filler sequence. As a non-limiting example, the filler sequence may bifurcate at least one region so that 80% of the region is located 5' to the filler sequence and 20% of the region is located 3' to the filler sequence. As a non-limiting example, the filler sequence may bifurcate at least one region so that 90% of the region is located 5' to the filler sequence and 10% of the region is located 3' to the filler sequence.

In one embodiment, the viral genome comprises a filler sequence after the 5' ITR.

In one embodiment, the viral genome comprises a filler sequence after the promoter region. In one embodiment, the viral genome comprises a filler sequence after the payload region. In one embodiment, the viral genome comprises a filler sequence after the intron region. In one embodiment, the viral genome comprises a filler sequence after the enhancer region. In one embodiment, the viral genome comprises a filler sequence after the polyadenylation signal sequence region. In one embodiment, the viral genome comprises a filler sequence after the MCS region. In one embodiment, the viral genome comprises a filler sequence after the exon region.

In one embodiment, the viral genome comprises a filler sequence before the promoter region. In one embodiment, the viral genome comprises a filler sequence before the payload region. In one embodiment, the viral genome comprises a filler sequence before the intron region. In one embodiment, the viral genome comprises a filler sequence before the enhancer region. In one embodiment, the viral genome comprises a filler sequence before the polyadenylation signal sequence region. In one embodiment, the viral genome comprises a filler sequence before the MCS region. In one embodiment, the viral genome comprises a filler sequence before the exon region.

In one embodiment, the viral genome comprises a filler sequence before the 3' ITR.

In one embodiment, a filler sequence may be located between two regions, such as, but not limited to, the 5' ITR and the promoter region. In one embodiment, a filler sequence may be located between two regions, such as, but not limited to, the 5' ITR and the payload region. In one embodiment, a filler sequence may be located between two regions, such as, but not limited to, the 5' ITR and the intron region. In one embodiment, a filler sequence may be located between two regions, such as, but not limited to, the 5' ITR and the enhancer region. In one embodiment, a filler sequence may be located between two regions, such as, but not limited to, the 5' ITR and the polyadenylation signal sequence region. In one embodiment, a filler sequence may be located between two regions, such as, but not limited to, the 5' ITR and the MCS region.

In one embodiment, a filler sequence may be located between two regions, such as, but not limited to, the 5' ITR and the exon region.

In one embodiment, a filler sequence may be located between two regions, such as, but not limited to, the promoter region and the payload region. In one embodiment, a filler sequence may be located between two regions, such as, but not limited to, the promoter region and the intron region. In one embodiment, a filler sequence may be located between two regions, such as, but not limited to, the promoter region and the enhancer region. In one embodiment, a filler sequence may be located between two regions, such as, but not limited to, the promoter region and the polyadenylation signal sequence region. In one embodiment, a filler sequence may be located between two regions, such as, but not limited to, the promoter region and the MCS region. In one embodiment, a filler sequence may be located between two regions, such as, but not limited to, the promoter region and the exon region. In one embodiment, a filler sequence may be located between two regions, such as, but not limited to, the promoter region and the 3' ITR.

In one embodiment, a filler sequence may be located between two regions, such as, but not limited to, the payload region and the intron region. In one embodiment, a filler sequence may be located between two regions, such as, but not limited to, the payload region and the enhancer region. In one embodiment, a filler sequence may be located between two regions, such as, but not limited to, the payload region and the polyadenylation signal sequence region. In one embodiment, a filler sequence may be located between two regions, such as, but not limited to, the payload region and the MCS region. In one embodiment, a filler sequence may be located between two regions, such as, but not limited to, the payload region and the exon region.

In one embodiment, a filler sequence may be located between two regions, such as, but not limited to, the payload region and the 3' ITR.

In one embodiment, a filler sequence may be located between two regions, such as, but not limited to, the intron region and the enhancer region. In one embodiment, a filler sequence may be located between two regions, such as, but not limited to, the intron region and the polyadenylation signal sequence region. In one embodiment, a filler sequence may be located between two regions, such as, but not limited to, the intron region and the MCS region. In one embodiment, a filler sequence may be located between two regions, such as, but not limited to, the intron region and the exon region. In one embodiment, a filler sequence may be located between two regions, such as, but not limited to, the intron region and the 3' ITR. In one embodiment, a filler sequence may be located between two regions, such as, but not limited to, the enhancer region and the polyadenylation signal sequence region. In one embodiment, a filler sequence may be located between two regions, such as, but not limited to, the enhancer region and the MCS region. In one embodiment, a filler sequence may be located between two regions, such as, but not limited to, the enhancer region and the exon region. In one embodiment, a filler sequence may be located between two regions, such as, but not limited to, the enhancer region and the 3' ITR.

In one embodiment, a filler sequence may be located between two regions, such as, but not limited to, the polyadenylation signal sequence region and the MCS region. In one embodiment, a filler sequence may be located between two regions, such as, but not limited to, the polyadenylation signal sequence region and the exon region. In one embodiment, a filler sequence may be located between two regions, such as, but not limited to, the polyadenylation signal sequence region and the 3' ITR.

In one embodiment, a filler sequence may be located between two regions, such as, but not limited to, the MCS region and the exon region. In one embodiment, a filler sequence may be located between two regions, such as, but not limited to, the MCS region and the 3' ITR.

In one embodiment, a filler sequence may be located between two regions, such as, but not limited to, the exon region and the 3' ITR.

In one embodiment, a viral genome may comprise two filler sequences, the first filler sequence may be located between the 5' ITR and promoter region, and the second filler sequence may be located between the promoter region and payload region. In one embodiment, a viral genome may comprise two filler sequences, the first filler sequence may be located between the 5' ITR and promoter region, and the second filler sequence may be located between the promoter region and intron region. In one embodiment, a viral genome may comprise two filler sequences, the first filler sequence may be located between the 5' ITR and promoter region, and the second filler sequence may be located between the promoter region and enhancer region. In one embodiment, a viral genome may comprise two filler sequences, the first filler sequence may be located between the 5' ITR and promoter region, and the second filler sequence may be located between the promoter region and polyadenylation signal sequence region. In one embodiment, a viral genome may comprise two filler sequences, the first filler sequence may be located between the 5' ITR and promoter region, and the second filler sequence may be located between the promoter region and MCS region. In one embodiment, a viral genome may comprise two filler sequences, the first filler sequence may be located between the 5' ITR and promoter region, and the second filler sequence may be located between the promoter region and exon region. In one embodiment, a viral genome may comprise two filler sequences, the first filler sequence may be located between the 5' ITR and promoter region, and the second filler sequence may be located between the promoter region and 3' ITR. In one embodiment, a viral genome may comprise two filler sequences, the first filler sequence may be located between the 5' ITR and promoter region, and the second filler sequence may be located between the payload region and intron region. In one embodiment, a viral genome may comprise two filler sequences, the first filler sequence may be located between the 5' ITR and promoter region, and the second filler sequence may be located between the payload region and enhancer region. In one embodiment, a viral genome may comprise two filler sequences, the first filler sequence may be located between the 5' ITR and promoter region, and the second filler sequence may be located between the payload region and polyadenylation signal sequence region. In one embodiment, a viral genome may comprise two filler sequences, the first filler sequence may be located between the 5' ITR and promoter region, and the second filler sequence may be located between the payload region and MCS region. In one embodiment, a viral genome may comprise two filler sequences, the first filler sequence may be located between the 5' ITR and promoter region, and the second filler sequence may be located between the payload region and exon region. In one embodiment, a viral genome may comprise two filler sequences, the first filler sequence may be located between the 5' ITR and promoter region, and the second filler sequence may be located between the payload region and 3' ITR. In one embodiment, a viral genome may comprise two filler sequences, the first filler sequence may be located between the 5' ITR and promoter region, and the second filler sequence may be located between the intron region and enhancer region. In one embodiment, a viral genome may comprise two filler sequences, the first filler sequence may be located between the 5' ITR and promoter region, and the second filler sequence may be located between the intron region and polyadenylation signal sequence region. In one embodiment, a viral genome may comprise two filler sequences, the first filler sequence may be located between the 5' ITR and promoter region, and the second filler sequence may be located between the intron region and MCS region. In one embodiment, a viral genome may comprise two filler sequences, the first filler sequence may be located between the 5' ITR and promoter region, and the second filler sequence may be located between the intron region and exon region. In one embodiment, a viral genome may comprise two filler sequences, the first filler sequence may be located between the 5' ITR and promoter region, and the second filler sequence may be located between the intron region and 3' ITR In one embodiment, a viral genome may comprise two filler sequences, the first filler sequence may be located between the 5' ITR and promoter region, and the second filler sequence may be located between the enhancer region and polyadenylation signal sequence region. In one embodiment, a viral genome may comprise two filler sequences, the first filler sequence may be located between the 5' ITR and promoter region, and the second filler sequence may be located between the enhancer region and MCS region. In one embodiment, a viral genome may comprise two filler sequences, the first filler sequence may be located between the 5' ITR and promoter region, and the second filler sequence may be located between the enhancer region and exon region. In one embodiment, a viral genome may comprise two filler sequences, the first filler sequence may be located between the 5' ITR and promoter region, and the second filler sequence may be located between the enhancer region and 3' ITR. In one embodiment, a viral genome may comprise two filler sequences, the first filler sequence may be located between the 5' ITR and promoter region, and the second filler sequence may be located between the polyadenylation signal sequence region and MCS region. In one embodiment, a viral genome may comprise two filler sequences, the first filler sequence may be located between the 5' ITR and promoter region, and the second filler sequence may be located between the polyadenylation signal sequence region and exon region. In one embodiment, a viral genome may comprise two filler sequences, the first filler sequence may be located between the 5' ITR and promoter region, and the second filler sequence may be located between the polyadenylation signal sequence region and 3' ITR. In one embodiment, a viral genome may comprise two filler sequences, the first filler sequence may be located between the 5' ITR and promoter region, and the second filler sequence may be located between the MCS region and exon region. In one embodiment, a viral genome may comprise two filler sequences, the first filler sequence may be located between the 5' ITR and promoter region, and the second filler sequence may be located between the MCS region and 3' ITR. In one embodiment, a viral genome may comprise two filler sequences, the first filler sequence may be located between the 5' ITR and promoter region, and the second filler sequence may be located between the exon region and 3' ITR.

In one embodiment, a viral genome may comprise two filler sequences, the first filler sequence may be located between the 5' ITR and payload region, and the second filler sequence may be located between the promoter region and payload region. In one embodiment, a viral genome may comprise two filler sequences, the first filler sequence may be located between the 5' ITR and payload region, and the second filler sequence may be located between the promoter region and intron region. In one embodiment, a viral genome may comprise two filler sequences, the first filler sequence may be located between the 5' ITR and payload region, and the second filler sequence may be located between the promoter region and enhancer region. In one embodiment, a viral genome may comprise two filler sequences, the first filler sequence may be located between the 5' ITR and payload region, and the second filler sequence may be located between the promoter region and polyadenylation signal sequence region. In one embodiment, a viral genome may comprise two filler sequences, the first filler sequence may be located between the 5' ITR and payload region, and the second filler sequence may be located between the promoter region and MCS region. In one embodiment, a viral genome may comprise two filler sequences, the first filler sequence may be located between the 5' ITR and payload region, and the second filler sequence may be located between the promoter region and exon region. In one embodiment, a viral genome may comprise two filler sequences, the first filler sequence may be located between the 5' ITR and payload region, and the second filler sequence may be located between the promoter region and 3' ITR. In one embodiment, a viral genome may comprise two filler sequences, the first filler sequence may be located between the 5' ITR and payload region, and the second filler sequence may be located between the payload region and intron region. In one embodiment, a viral genome may comprise two filler sequences, the first filler sequence may be located between the 5' ITR and payload region, and the second filler sequence may be located between the payload region and enhancer region. In one embodiment, a viral genome may comprise two filler sequences, the first filler sequence may be located between the 5' ITR and payload region, and the second filler sequence may be located between the payload region and polyadenylation signal sequence region. In one embodiment, a viral genome may comprise two filler sequences, the first filler sequence may be located between the 5' ITR and payload region, and the second filler sequence may be located between the payload region and MCS region. In one embodiment, a viral genome may comprise two filler sequences, the first filler sequence may be located between the 5' ITR and payload region, and the second filler sequence may be located between the payload region and exon region. In one embodiment, a viral genome may comprise two filler sequences, the first filler sequence may be located between the 5' ITR and payload region, and the second filler sequence may be located between the payload region and 3' ITR. In one embodiment, a viral genome may comprise two filler sequences, the first filler sequence may be located between the 5' ITR and payload region, and the second filler sequence may be located between the intron region and enhancer region. In one embodiment, a viral genome may comprise two filler sequences, the first filler sequence may be located between the 5' ITR and payload region, and the second filler sequence may be located between the intron region and polyadenylation signal sequence region. In one embodiment, a viral genome may comprise two filler sequences, the first filler sequence may be located between the 5' ITR and payload region, and the second filler sequence may be located between the intron region and MCS region. In one embodiment, a viral genome may comprise two filler sequences, the first filler sequence may be located between the 5' ITR and payload region, and the second filler sequence may be located between the intron region and exon region. In one embodiment, a viral genome may comprise two filler sequences, the first filler sequence may be located between the 5' ITR and payload region, and the second filler sequence may be located between the intron region and 3' ITR. In one embodiment, a viral genome may comprise two filler sequences, the first filler sequence may be located between the 5' ITR and payload region, and the second filler sequence may be located between the enhancer region and polyadenylation signal sequence region. In one embodiment, a viral genome may comprise two filler sequences, the first filler sequence may be located between the 5' ITR and payload region, and the second filler sequence may be located between the enhancer region and MCS region. In one embodiment, a viral genome may comprise two filler sequences, the first filler sequence may be located between the 5' ITR and payload region, and the second filler sequence may be located between the enhancer region and exon region. In one embodiment, a viral genome may comprise two filler sequences, the first filler sequence may be located between the 5' ITR and payload region, and the second filler sequence may be located between the enhancer region and 3' ITR. In one embodiment, a viral genome may comprise two filler sequences, the first filler sequence may be located between the 5' ITR and payload region, and the second filler sequence may be located between the polyadenylation signal sequence region and MCS region. In one embodiment, a viral genome may comprise two filler sequences, the first filler sequence may be located between the 5' ITR and payload region, and the second filler sequence may be located between the polyadenylation signal sequence region and exon region. In one embodiment, a viral genome may comprise two filler sequences, the first filler sequence may be located between the 5' ITR and payload region, and the second filler sequence may be located between the polyadenylation signal sequence region and 3' ITR. In one embodiment, a viral genome may comprise two filler sequences, the first filler sequence may be located between the 5' ITR and payload region, and the second filler sequence may be located between the MCS region and exon region. In one embodiment, a viral genome may comprise two filler sequences, the first filler sequence may be located between the 5' ITR and payload region, and the second filler sequence may be located between the MCS region and 3' ITR. In one embodiment, a viral genome may comprise two filler sequences, the first filler sequence may be located between the 5' ITR and payload region, and the second filler sequence may be located between the exon region and 3' ITR.

In one embodiment, a viral genome may comprise two filler sequences, the first filler sequence may be located between the 5' ITR and intron region, and the second filler sequence may be located between the promoter region and payload region. In one embodiment, a viral genome may comprise two filler sequences, the first filler sequence may be located between the 5' ITR and intron region, and the second filler sequence may be located between the promoter region and intron region. In one embodiment, a viral genome may comprise two filler sequences, the first filler sequence may be located between the 5' ITR and intron region, and the second filler sequence may be located between the promoter region and enhancer region. In one embodiment, a viral genome may comprise two filler sequences, the first filler sequence may be located between the 5' ITR and intron region, and the second filler sequence may be located between the promoter region and polyadenylation signal sequence region. In one embodiment, a viral genome may comprise two filler sequences, the first filler sequence may be located between the 5' ITR and intron region, and the second filler sequence may be located between the promoter region and MCS region. In one embodiment, a viral genome may comprise two filler sequences, the first filler sequence may be located between the 5' ITR and intron region, and the second filler sequence may be located between the promoter region and exon region. In one embodiment, a viral genome may comprise two filler sequences, the first filler sequence may be located between the 5' ITR and intron region, and the second filler sequence may be located between the promoter region and 3' ITR. In one embodiment, a viral genome may comprise two filler sequences, the first filler sequence may be located between the 5' ITR and intron region, and the second filler sequence may be located between the payload region and intron region. In one embodiment, a viral genome may comprise two filler sequences, the first filler sequence may be located between the 5' ITR and intron region, and the second filler sequence may be located between the payload region and enhancer region. In one embodiment, a viral genome may comprise two filler sequences, the first filler sequence may be located between the 5' ITR and intron region, and the second filler sequence may be located between the payload region and polyadenylation signal sequence region. In one embodiment, a viral genome may comprise two filler sequences, the first filler sequence may be located between the 5' ITR and intron region, and the second filler sequence may be located between the payload region and MCS region. In one embodiment, a viral genome may comprise two filler sequences, the first filler sequence may be located between the 5' ITR and intron region, and the second filler sequence may be located between the payload region and exon region. In one embodiment, a viral genome may comprise two filler sequences, the first filler sequence may be located between the 5' ITR and intron region, and the second filler sequence may be located between the payload region and 3' ITR. In one embodiment, a viral genome may comprise two filler sequences, the first filler sequence may be located between the 5' ITR and intron region, and the second filler sequence may be located between the intron region and enhancer region. In one embodiment, a viral genome may comprise two filler sequences, the first filler sequence may be located between the 5' ITR and intron region, and the second filler sequence may be located between the intron region and polyadenylation signal sequence region. In one embodiment, a viral genome may comprise two filler sequences, the first filler sequence may be located between the 5' ITR and intron region, and the second filler sequence may be located between the intron region and MCS region. In one embodiment, a viral genome may comprise two filler sequences, the first filler sequence may be located between the 5' ITR and intron region, and the second filler sequence may be located between the intron region and exon region. In one embodiment, a viral genome may comprise two filler sequences, the first filler sequence may be located between the 5' ITR and intron region, and the second filler sequence may be located between the intron region and 3' ITR. In one embodiment, a viral genome may comprise two filler sequences, the first filler sequence may be located between the 5' ITR and intron region, and the second filler sequence may be located between the enhancer region and polyadenylation signal sequence region. In one embodiment, a viral genome may comprise two filler sequences, the first filler sequence may be located between the 5' ITR and intron region, and the second filler sequence may be located between the enhancer region and MCS region. In one embodiment, a viral genome may comprise two filler sequences, the first filler sequence may be located between the 5' ITR and intron region, and the second filler sequence may be located between the enhancer region and exon region. In one embodiment, a viral genome may comprise two filler sequences, the first filler sequence may be located between the 5' ITR and intron region, and the second filler sequence may be located between the enhancer region and 3' ITR. In one embodiment, a viral genome may comprise two filler sequences, the first filler sequence may be located between the 5' ITR and intron region, and the second filler sequence may be located between the polyadenylation signal sequence region and MCS region. In one embodiment, a viral genome may comprise two filler sequences, the first filler sequence may be located between the 5' ITR and intron region, and the second filler sequence may be located between the polyadenylation signal sequence region and exon region. In one embodiment, a viral genome may comprise two filler sequences, the first filler sequence may be located between the 5' ITR and intron region, and the second filler sequence may be located between the polyadenylation signal sequence region and 3' ITR. In one embodiment, a viral genome may comprise two filler sequences, the first filler sequence may be located between the 5' ITR and intron region, and the second filler sequence may be located between the MCS region and exon region. In one embodiment, a viral genome may comprise two filler sequences, the first filler sequence may be located between the 5' ITR and intron region, and the second filler sequence may be located between the MCS region and 3' ITR. In one embodiment, a viral genome may comprise two filler sequences, the first filler sequence may be located between the 5' ITR and intron region, and the second filler sequence may be located between the exon region and 3' ITR.

In one embodiment, a viral genome may comprise two filler sequences, the first filler sequence may be located between the 5' ITR and enhancer region, and the second filler sequence may be located between the promoter region and payload region. In one embodiment, a viral genome may comprise two filler sequences, the first filler sequence may be located between the 5' ITR and enhancer region, and the second filler sequence may be located between the promoter region and intron region. In one embodiment, a viral genome may comprise two filler sequences, the first filler sequence may be located between the 5' ITR and enhancer region, and the second filler sequence may be located between the promoter region and enhancer region. In one embodiment, a viral genome may comprise two filler sequences, the first filler sequence may be located between the 5' ITR and enhancer region, and the second filler sequence may be located between the promoter region and polyadenylation signal sequence region. In one embodiment, a viral genome may comprise two filler sequences, the first filler sequence may be located between the 5' ITR and enhancer region, and the second filler sequence may be located between the promoter region and MCS region. In one embodiment, a viral genome may comprise two filler sequences, the first filler sequence may be located between the 5' ITR and enhancer region, and the second filler sequence may be located between the promoter region and exon region. In one embodiment, a viral genome may comprise two filler sequences, the first filler sequence may be located between the 5' ITR and enhancer region, and the second filler sequence may be located between the promoter region and 3' ITR. In one embodiment, a viral genome may comprise two filler sequences, the first filler sequence may be located between the 5' ITR and enhancer region, and the second filler sequence may be located between the payload region and intron region. In one embodiment, a viral genome may comprise two filler sequences, the first filler sequence may be located between the 5' ITR and enhancer region, and the second filler sequence may be located between the payload region and enhancer region. In one embodiment, a viral genome may comprise two filler sequences, the first filler sequence may be located between the 5' ITR and enhancer region, and the second filler sequence may be located between the payload region and polyadenylation signal sequence region. In one embodiment, a viral genome may comprise two filler sequences, the first filler sequence may be located between the 5' ITR and enhancer region, and the second filler sequence may be located between the payload region and MCS region. In one embodiment, a viral genome may comprise two filler sequences, the first filler sequence may be located between the 5' ITR and enhancer region, and the second filler sequence may be located between the payload region and exon region. In one embodiment, a viral genome may comprise two filler sequences, the first filler sequence may be located between the 5' ITR and enhancer region, and the second filler sequence may be located between the payload region and 3' ITR. In one embodiment, a viral genome may comprise two filler sequences, the first filler sequence may be located between the 5' ITR and enhancer region, and the second filler sequence may be located between the intron region and enhancer region. In one embodiment, a viral genome may comprise two filler sequences, the first filler sequence may be located between the 5' ITR and enhancer region, and the second filler sequence may be located between the intron region and polyadenylation signal sequence region. In one embodiment, a viral genome may comprise two filler sequences, the first filler sequence may be located between the 5' ITR and enhancer region, and the second filler sequence may be located between the intron region and MCS region. In one embodiment, a viral genome may comprise two filler sequences, the first filler sequence may be located between the 5' ITR and enhancer region, and the second filler sequence may be located between the intron region and exon region. In one embodiment, a viral genome may comprise two filler sequences, the first filler sequence may be located between the 5' ITR and enhancer region, and the second filler sequence may be located between the intron region and 3' ITR. In one embodiment, a viral genome may comprise two filler sequences, the first filler sequence may be located between the 5' ITR and enhancer region, and the second filler sequence may be located between the enhancer region and polyadenylation signal sequence region. In one embodiment, a viral genome may comprise two filler sequences, the first filler sequence may be located between the 5' ITR and enhancer region, and the second filler sequence may be located between the enhancer region and MCS region. In one embodiment, a viral genome may comprise two filler sequences, the first filler sequence may be located between the 5' ITR and enhancer region, and the second filler sequence may be located between the enhancer region and exon region. In one embodiment, a viral genome may comprise two filler sequences, the first filler sequence may be located between the 5' ITR and enhancer region, and the second filler sequence may be located between the enhancer region and 3' ITR. In one embodiment, a viral genome may comprise two filler sequences, the first filler sequence may be located between the 5' ITR and enhancer region, and the second filler sequence may be located between the polyadenylation signal sequence region and MCS region. In one embodiment, a viral genome may comprise two filler sequences, the first filler sequence may be located between the 5' ITR and enhancer region, and the second filler sequence may be located between the polyadenylation signal sequence region and exon region. In one embodiment, a viral genome may comprise two filler sequences, the first filler sequence may be located between the 5' ITR and enhancer region, and the second filler sequence may be located between the polyadenylation signal sequence region and 3' ITR. In one embodiment, a viral genome may comprise two filler sequences, the first filler sequence may be located between the 5' ITR and enhancer region, and the second filler sequence may be located between the MCS region and exon region. In one embodiment, a viral genome may comprise two filler sequences, the first filler sequence may be located between the 5' ITR and enhancer region, and the second filler sequence may be located between the MCS region and 3' ITR. In one embodiment, a viral genome may comprise two filler sequences, the first filler sequence may be located between the 5' ITR and enhancer region, and the second filler sequence may be located between the exon region and 3' ITR.

In one embodiment, a viral genome may comprise two filler sequences, the first filler sequence may be located between the 5' ITR and polyadenylation signal sequence region, and the second filler sequence may be located between the promoter region and payload region. In one embodiment, a viral genome may comprise two filler sequences, the first filler sequence may be located between the 5' ITR and polyadenylation signal sequence region, and the second filler sequence may be located between the promoter region and intron region. In one embodiment, a viral genome may comprise two filler sequences, the first filler sequence may be located between the 5' ITR and polyadenylation signal sequence region, and the second filler sequence may be located between the promoter region and enhancer region. In one embodiment, a viral genome may comprise two filler sequences, the first filler sequence may be located between the 5' ITR and polyadenylation signal sequence region, and the second filler sequence may be located between the promoter region and polyadenylation signal sequence region. In one embodiment, a viral genome may comprise two filler sequences, the first filler sequence may be located between the 5' ITR and polyadenylation signal sequence region, and the second filler sequence may be located between the promoter region and MCS region. In one embodiment, a viral genome may comprise two filler sequences, the first filler sequence may be located between the 5' ITR and polyadenylation signal sequence region, and the second filler sequence may be located between the promoter region and exon region. In one embodiment, a viral genome may comprise two filler sequences, the first filler sequence may be located between the 5' ITR and polyadenylation signal sequence region, and the second filler sequence may be located between the promoter region and 3' ITR. In one embodiment, a viral genome may comprise two filler sequences, the first filler sequence may be located between the 5' ITR and polyadenylation signal sequence region, and the second filler sequence may be located between the payload region and intron region. In one embodiment, a viral genome may comprise two filler sequences, the first filler sequence may be located between the 5' ITR and polyadenylation signal sequence region, and the second filler sequence may be located between the payload region and enhancer region. In one embodiment, a viral genome may comprise two filler sequences, the first filler sequence may be located between the 5' ITR and polyadenylation signal sequence region, and the second filler sequence may be located between the payload region and polyadenylation signal sequence region. In one embodiment, a viral genome may comprise two filler sequences, the first filler sequence may be located between the 5' ITR and polyadenylation signal sequence region, and the second filler sequence may be located between the payload region and MCS region. In one embodiment, a viral genome may comprise two filler sequences, the first filler sequence may be located between the 5' ITR and polyadenylation signal sequence region, and the second filler sequence may be located between the payload region and exon region. In one embodiment, a viral genome may comprise two filler sequences, the first filler sequence may be located between the 5' ITR and polyadenylation signal sequence region, and the second filler sequence may be located between the payload region and 3' ITR. In one embodiment, a viral genome may comprise two filler sequences, the first filler sequence may be located between the 5' ITR and polyadenylation signal sequence region, and the second filler sequence may be located between the intron region and enhancer region. In one embodiment, a viral genome may comprise two filler sequences, the first filler sequence may be located between the 5' ITR and polyadenylation signal sequence region, and the second filler sequence may be located between the intron region and polyadenylation signal sequence region. In one embodiment, a viral genome may comprise two filler sequences, the first filler sequence may be located between the 5' ITR and polyadenylation signal sequence region, and the second filler sequence may be located between the intron region and MCS region. In one embodiment, a viral genome may comprise two filler sequences, the first filler sequence may be located between the 5' ITR and polyadenylation signal sequence region, and the second filler sequence may be located between the intron region and exon region. In one embodiment, a viral genome may comprise two filler sequences, the first filler sequence may be located between the 5' ITR and polyadenylation signal sequence region, and the second filler sequence may be located between the intron region and 3' ITR. In one embodiment, a viral genome may comprise two filler sequences, the first filler sequence may be located between the 5' ITR and polyadenylation signal sequence region, and the second filler sequence may be located between the enhancer region and polyadenylation signal sequence region. In one embodiment, a viral genome may comprise two filler sequences, the first filler sequence may be located between the 5' ITR and polyadenylation signal sequence region, and the second filler sequence may be located between the enhancer region and MCS region. In one embodiment, a viral genome may comprise two filler sequences, the first filler sequence may be located between the 5' ITR and polyadenylation signal sequence region, and the second filler sequence may be located between the enhancer region and exon region. In one embodiment, a viral genome may comprise two filler sequences, the first filler sequence may be located between the 5' ITR and polyadenylation signal sequence region, and the second filler sequence may be located between the enhancer region and 3' ITR. In one embodiment, a viral genome may comprise two filler sequences, the first filler sequence may be located between the 5' ITR and polyadenylation signal sequence region, and the second filler sequence may be located between the polyadenylation signal sequence region and MCS region. In one embodiment, a viral genome may comprise two filler sequences, the first filler sequence may be located between the 5' ITR and polyadenylation signal sequence region, and the second filler sequence may be located between the polyadenylation signal sequence region and exon region. In one embodiment, a viral genome may comprise two filler sequences, the first filler sequence may be located between the 5' ITR and polyadenylation signal sequence region, and the second filler sequence may be located between the polyadenylation signal sequence region and 3' ITR. In one embodiment, a viral genome may comprise two filler sequences, the first filler sequence may be located between the 5' ITR and polyadenylation signal sequence region, and the second filler sequence may be located between the MCS region and exon region. In one embodiment, a viral genome may comprise two filler sequences, the first filler sequence may be located between the 5' ITR and polyadenylation signal sequence region, and the second filler sequence may be located between the MCS region and 3' ITR. In one embodiment, a viral genome may comprise two filler sequences, the first filler sequence may be located between the 5' ITR and polyadenylation signal sequence region, and the second filler sequence may be located between the exon region and 3' ITR.

In one embodiment, a viral genome may comprise two filler sequences, the first filler sequence may be located between the 5' ITR and MCS region, and the second filler sequence may be located between the promoter region and payload region. In one embodiment, a viral genome may comprise two filler sequences, the first filler sequence may be located between the 5' ITR and MCS region, and the second filler sequence may be located between the promoter region and intron region. In one embodiment, a viral genome may comprise two filler sequences, the first filler sequence may be located between the 5' ITR and MCS region, and the second filler sequence may be located between the promoter region and enhancer region. In one embodiment, a viral genome may comprise two filler sequences, the first filler sequence may be located between the 5' ITR and MCS region, and the second filler sequence may be located between the promoter region and polyadenylation signal sequence region. In one embodiment, a viral genome may comprise two filler sequences, the first filler sequence may be located between the 5' ITR and MCS region, and the second filler sequence may be located between the promoter region and MCS region. In one embodiment, a viral genome may comprise two filler sequences, the first filler sequence may be located between the 5' ITR and MCS region, and the second filler sequence may be located between the promoter region and exon region. In one embodiment, a viral genome may comprise two filler sequences, the first filler sequence may be located between the 5' ITR and MCS region, and the second filler sequence may be located between the promoter region and 3' ITR. In one embodiment, a viral genome may comprise two filler sequences, the first filler sequence may be located between the 5' ITR and MCS region, and the second filler sequence may be located between the payload region and intron region. In one embodiment, a viral genome may comprise two filler sequences, the first filler sequence may be located between the 5' ITR and MCS region, and the second filler sequence may be located between the payload region and enhancer region. In one embodiment, a viral genome may comprise two filler sequences, the first filler sequence may be located between the 5' ITR and MCS region, and the second filler sequence may be located between the payload region and polyadenylation signal sequence region. In one embodiment, a viral genome may comprise two filler sequences, the first filler sequence may be located between the 5' ITR and MCS region, and the second filler sequence may be located between the payload region and MCS region. In one embodiment, a viral genome may comprise two filler sequences, the first filler sequence may be located between the 5' ITR and MCS region, and the second filler sequence may be located between the payload region and exon region. In one embodiment, a viral genome may comprise two filler sequences, the first filler sequence may be located between the 5' ITR and MCS region, and the second filler sequence may be located between the payload region and 3' ITR. In one embodiment, a viral genome may comprise two filler sequences, the first filler sequence may be located between the 5' ITR and MCS region, and the second filler sequence may be located between the intron region and enhancer region. In one embodiment, a viral genome may comprise two filler sequences, the first filler sequence may be located between the 5' ITR and MCS region, and the second filler sequence may be located between the intron region and polyadenylation signal sequence region. In one embodiment, a viral genome may comprise two filler sequences, the first filler sequence may be located between the 5' ITR and MCS region, and the second filler sequence may be located between the intron region and MCS region. In one embodiment, a viral genome may comprise two filler sequences, the first filler sequence may be located between the 5' ITR and MCS region, and the second filler sequence may be located between the intron region and exon region. In one embodiment, a viral genome may comprise two filler sequences, the first filler sequence may be located between the 5' ITR and MCS region, and the second filler sequence may be located between the intron region and 3' ITR. In one embodiment, a viral genome may comprise two filler sequences, the first filler sequence may be located between the 5' ITR and MCS region, and the second filler sequence may be located between the enhancer region and polyadenylation signal sequence region. In one embodiment, a viral genome may comprise two filler sequences, the first filler sequence may be located between the 5' ITR and MCS region, and the second filler sequence may be located between the enhancer region and MCS region. In one embodiment, a viral genome may comprise two filler sequences, the first filler sequence may be located between the 5' ITR and MCS region, and the second filler sequence may be located between the enhancer region and exon region. In one embodiment, a viral genome may comprise two filler sequences, the first filler sequence may be located between the 5' ITR and MCS region, and the second filler sequence may be located between the enhancer region and 3' ITR. In one embodiment, a viral genome may comprise two filler sequences, the first filler sequence may be located between the 5' ITR and MCS region, and the second filler sequence may be located between the polyadenylation signal sequence region and MCS region. In one embodiment, a viral genome may comprise two filler sequences, the first filler sequence may be located between the 5' ITR and MCS region, and the second filler sequence may be located between the polyadenylation signal sequence region and exon region. In one embodiment, a viral genome may comprise two filler sequences, the first filler sequence may be located between the 5' ITR and MCS region, and the second filler sequence may be located between the polyadenylation signal sequence region and 3' ITR. In one embodiment, a viral genome may comprise two filler sequences, the first filler sequence may be located between the 5' ITR and MCS region, and the second filler sequence may be located between the MCS region and exon region. In one embodiment, a viral genome may comprise two filler sequences, the first filler sequence may be located between the 5' ITR and MCS region, and the second filler sequence may be located between the MCS region and 3' ITR. In one embodiment, a viral genome may comprise two filler sequences, the first filler sequence may be located between the 5' ITR and MCS region, and the second filler sequence may be located between the exon region and 3' ITR.

In one embodiment, a viral genome may comprise two filler sequences, the first filler sequence may be located between the 5' ITR and exon region, and the second filler sequence may be located between the promoter region and payload region. In one embodiment, a viral genome may comprise two filler sequences, the first filler sequence may be located between the 5' ITR and exon region, and the second filler sequence may be located between the promoter region and intron region. In one embodiment, a viral genome may comprise two filler sequences, the first filler sequence may be located between the 5' ITR and exon region, and the second filler sequence may be located between the promoter region and enhancer region. In one embodiment, a viral genome may comprise two filler sequences, the first filler sequence may be located between the 5' ITR and exon region, and the second filler sequence may be located between the promoter region and polyadenylation signal sequence region. In one embodiment, a viral genome may comprise two filler sequences, the first filler sequence may be located between the 5' ITR and exon region, and the second filler sequence may be located between the promoter region and MCS region. In one embodiment, a viral genome may comprise two filler sequences, the first filler sequence may be located between the 5' ITR and exon region, and the second filler sequence may be located between the promoter region and exon region. In one embodiment, a viral genome may comprise two filler sequences, the first filler sequence may be located between the 5' ITR and exon region, and the second filler sequence may be located between the promoter region and 3' ITR. In one embodiment, a viral genome may comprise two filler sequences, the first filler sequence may be located between the 5' ITR and exon region, and the second filler sequence may be located between the payload region and intron region. In one embodiment, a viral genome may comprise two filler sequences, the first filler sequence may be located between the 5' ITR and exon region, and the second filler sequence may be located between the payload region and enhancer region. In one embodiment, a viral genome may comprise two filler sequences, the first filler sequence may be located between the 5' ITR and exon region, and the second filler sequence may be located between the payload region and polyadenylation signal sequence region. In one embodiment, a viral genome may comprise two filler sequences, the first filler sequence may be located between the 5' ITR and exon region, and the second filler sequence may be located between the payload region and MCS region. In one embodiment, a viral genome may comprise two filler sequences, the first filler sequence may be located between the 5' ITR and exon region, and the second filler sequence may be located between the payload region and exon region. In one embodiment, a viral genome may comprise two filler sequences, the first filler sequence may be located between the 5' ITR and exon region, and the second filler sequence may be located between the payload region and 3' ITR. In one embodiment, a viral genome may comprise two filler sequences, the first filler sequence may be located between the 5' ITR and exon region, and the second filler sequence may be located between the intron region and enhancer region. In one embodiment, a viral genome may comprise two filler sequences, the first filler sequence may be located between the 5' ITR and exon region, and the second filler sequence may be located between the intron region and polyadenylation signal sequence region. In one embodiment, a viral genome may comprise two filler sequences, the first filler sequence may be located between the 5' ITR and exon region, and the second filler sequence may be located between the intron region and MCS region. In one embodiment, a viral genome may comprise two filler sequences, the first filler sequence may be located between the 5' ITR and exon region, and the second filler sequence may be located between the intron region and exon region. In one embodiment, a viral genome may comprise two filler sequences, the first filler sequence may be located between the 5' ITR and exon region, and the second filler sequence may be located between the intron region and 3' ITR. In one embodiment, a viral genome may comprise two filler sequences, the first filler sequence may be located between the 5' ITR and exon region, and the second filler sequence may be located between the enhancer region and polyadenylation signal sequence region. In one embodiment, a viral genome may comprise two filler sequences, the first filler sequence may be located between the 5' ITR and exon region, and the second filler sequence may be located between the enhancer region and MCS region. In one embodiment, a viral genome may comprise two filler sequences, the first filler sequence may be located between the 5' ITR and exon region, and the second filler sequence may be located between the enhancer region and exon region. In one embodiment, a viral genome may comprise two filler sequences, the first filler sequence may be located between the 5' ITR and exon region, and the second filler sequence may be located between the enhancer region and 3' ITR. In one embodiment, a viral genome may comprise two filler sequences, the first filler sequence may be located between the 5' ITR and exon region, and the second filler sequence may be located between the polyadenylation signal sequence region and MCS region. In one embodiment, a viral genome may comprise two filler sequences, the first filler sequence may be located between the 5' ITR and exon region, and the second filler sequence may be located between the polyadenylation signal sequence region and exon region. In one embodiment, a viral genome may comprise two filler sequences, the first filler sequence may be located between the 5' ITR and exon region, and the second filler sequence may be located between the polyadenylation signal sequence region and 3' ITR. In one embodiment, a viral genome may comprise two filler sequences, the first filler sequence may be located between the 5' ITR and exon region, and the second filler sequence may be located between the MCS region and exon region. In one embodiment, a viral genome may comprise two filler sequences, the first filler sequence may be located between the 5' ITR and exon region, and the second filler sequence may be located between the MCS region and 3' ITR. In one embodiment, a viral genome may comprise two filler sequences, the first filler sequence may be located between the 5' ITR and exon region, and the second filler sequence may be located between the exon region and 3' ITR.

In one embodiment, a viral genome may comprise two filler sequences, the first filler sequence may be located between the promoter region and payload region, and the second filler sequence may be located between the payload region and intron region. In one embodiment, a viral genome may comprise two filler sequences, the first filler sequence may be located between the promoter region and payload region, and the second filler sequence may be located between the payload region and enhancer region. In one embodiment, a viral genome may comprise two filler sequences, the first filler sequence may be located between the promoter region and payload region, and the second filler sequence may be located between the payload region and polyadenylation signal sequence region. In one embodiment, a viral genome may comprise two filler sequences, the first filler sequence may be located between the promoter region and payload region, and the second filler sequence may be located between the payload region and MCS region. In one embodiment, a viral genome may comprise two filler sequences, the first filler sequence may be located between the promoter region and payload region, and the second filler sequence may be located between the payload region and exon region. In one embodiment, a viral genome may comprise two filler sequences, the first filler sequence may be located between the promoter region and payload region, and the second filler sequence may be located between the payload region and 3' ITR. In one embodiment, a viral genome may comprise two filler sequences, the first filler sequence may be located between the promoter region and payload region, and the second filler sequence may be located between the intron region and enhancer region. In one embodiment, a viral genome may comprise two filler sequences, the first filler sequence may be located between the promoter region and payload region, and the second filler sequence may be located between the intron region and polyadenylation signal sequence region. In one embodiment, a viral genome may comprise two filler sequences, the first filler sequence may be located between the promoter region and payload region, and the second filler sequence may be located between the intron region and MCS region. In one embodiment, a viral genome may comprise two filler sequences, the first filler sequence may be located between the promoter region and payload region, and the second filler sequence may be located between the intron region and exon region. In one embodiment, a viral genome may comprise two filler sequences, the first filler sequence may be located between the promoter region and payload region, and the second filler sequence may be located between the intron region and 3' ITR. In one embodiment, a viral genome may comprise two filler sequences, the first filler sequence may be located between the promoter region and payload region, and the second filler sequence may be located between the enhancer region and polyadenylation signal sequence region. In one embodiment, a viral genome may comprise two filler sequences, the first filler sequence may be located between the promoter region and payload region, and the second filler sequence may be located between the enhancer region and MCS region. In one embodiment, a viral genome may comprise two filler sequences, the first filler sequence may be located between the promoter region and payload region, and the second filler sequence may be located between the enhancer region and exon region. In one embodiment, a viral genome may comprise two filler sequences, the first filler sequence may be located between the promoter region and payload region, and the second filler sequence may be located between the enhancer region and 3' ITR. In one embodiment, a viral genome may comprise two filler sequences, the first filler sequence may be located between the promoter region and payload region, and the second filler sequence may be located between the polyadenylation signal sequence region and MCS region. In one embodiment, a viral genome may comprise two filler sequences, the first filler sequence may be located between the promoter region and payload region, and the second filler sequence may be located between the polyadenylation signal sequence region and exon region. In one embodiment, a viral genome may comprise two filler sequences, the first filler sequence may be located between the promoter region and payload region, and the second filler sequence may be located between the polyadenylation signal sequence region and 3' ITR. In one embodiment, a viral genome may comprise two filler sequences, the first filler sequence may be located between the promoter region and payload region, and the second filler sequence may be located between the MCS region and exon region. In one embodiment, a viral genome may comprise two filler sequences, the first filler sequence may be located between the promoter region and payload region, and the second filler sequence may be located between the MCS region and 3' ITR. In one embodiment, a viral genome may comprise two filler sequences, the first filler sequence may be located between the promoter region and payload region, and the second filler sequence may be located between the exon region and 3' ITR.

In one embodiment, a viral genome may comprise two filler sequences, the first filler sequence may be located between the promoter region and intron region, and the second filler sequence may be located between the payload region and intron region. In one embodiment, a viral genome may comprise two filler sequences, the first filler sequence may be located between the promoter region and intron region, and the second filler sequence may be located between the payload region and enhancer region. In one embodiment, a viral genome may comprise two filler sequences, the first filler sequence may be located between the promoter region and intron region, and the second filler sequence may be located between the payload region and polyadenylation signal sequence region. In one embodiment, a viral genome may comprise two filler sequences, the first filler sequence may be located between the promoter region and intron region, and the second filler sequence may be located between the payload region and MCS region. In one embodiment, a viral genome may comprise two filler sequences, the first filler sequence may be located between the promoter region and intron region, and the second filler sequence may be located between the payload region and exon region. In one embodiment, a viral genome may comprise two filler sequences, the first filler sequence may be located between the promoter region and intron region, and the second filler sequence may be located between the payload region and 3' ITR. In one embodiment, a viral genome may comprise two filler sequences, the first filler sequence may be located between the promoter region and intron region, and the second filler sequence may be located between the intron region and enhancer region. In one embodiment, a viral genome may comprise two filler sequences, the first filler sequence may be located between the promoter region and intron region, and the second filler sequence may be located between the intron region and polyadenylation signal sequence region. In one embodiment, a viral genome may comprise two filler sequences, the first filler sequence may be located between the promoter region and intron region, and the second filler sequence may be located between the intron region and MCS region. In one embodiment, a viral genome may comprise two filler sequences, the first filler sequence may be located between the promoter region and intron region, and the second filler sequence may be located between the intron region and exon region. In one embodiment, a viral genome may comprise two filler sequences, the first filler sequence may be located between the promoter region and intron region, and the second filler sequence may be located between the intron region and 3' ITR. In one embodiment, a viral genome may comprise two filler sequences, the first filler sequence may be located between the promoter region and intron region, and the second filler sequence may be located between the enhancer region and polyadenylation signal sequence region. In one embodiment, a viral genome may comprise two filler sequences, the first filler sequence may be located between the promoter region and intron region, and the second filler sequence may be located between the enhancer region and MCS region. In one embodiment, a viral genome may comprise two filler sequences, the first filler sequence may be located between the promoter region and intron region, and the second filler sequence may be located between the enhancer region and exon region. In one embodiment, a viral genome may comprise two filler sequences, the first filler sequence may be located between the promoter region and intron region, and the second filler sequence may be located between the enhancer region and 3' ITR. In one embodiment, a viral genome may comprise two filler sequences, the first filler sequence may be located between the promoter region and intron region, and the second filler sequence may be located between the polyadenylation signal sequence region and MCS region. In one embodiment, a viral genome may comprise two filler sequences, the first filler sequence may be located between the promoter region and intron region, and the second filler sequence may be located between the polyadenylation signal sequence region and exon region. In one embodiment, a viral genome may comprise two filler sequences, the first filler sequence may be located between the promoter region and intron region, and the second filler sequence may be located between the polyadenylation signal sequence region and 3' ITR. In one embodiment, a viral genome may comprise two filler sequences, the first filler sequence may be located between the promoter region and intron region, and the second filler sequence may be located between the MCS region and exon region. In one embodiment, a viral genome may comprise two filler sequences, the first filler sequence may be located between the promoter region and intron region, and the second filler sequence may be located between the MCS region and 3' ITR. In one embodiment, a viral genome may comprise two filler sequences, the first filler sequence may be located between the promoter region and intron region, and the second filler sequence may be located between the exon region and 3' ITR.

In one embodiment, a viral genome may comprise two filler sequences, the first filler sequence may be located between the promoter region and enhancer region, and the second filler sequence may be located between the payload region and intron region. In one embodiment, a viral genome may comprise two filler sequences, the first filler sequence may be located between the promoter region and enhancer region, and the second filler sequence may be located between the payload region and enhancer region. In one embodiment, a viral genome may comprise two filler sequences, the first filler sequence may be located between the promoter region and enhancer region, and the second filler sequence may be located between the payload region and polyadenylation signal sequence region. In one embodiment, a viral genome may comprise two filler sequences, the first filler sequence may be located between the promoter region and enhancer region, and the second filler sequence may be located between the payload region and MCS region. In one embodiment, a viral genome may comprise two filler sequences, the first filler sequence may be located between the promoter region and enhancer region, and the second filler sequence may be located between the payload region and exon region. In one embodiment, a viral genome may comprise two filler sequences, the first filler sequence may be located between the promoter region and enhancer region, and the second filler sequence may be located between the payload region and 3' ITR. In one embodiment, a viral genome may comprise two filler sequences, the first filler sequence may be located between the promoter region and enhancer region, and the second filler sequence may be located between the intron region and enhancer region. In one embodiment, a viral genome may comprise two filler sequences, the first filler sequence may be located between the promoter region and enhancer region, and the second filler sequence may be located between the intron region and polyadenylation signal sequence region. In one embodiment, a viral genome may comprise two filler sequences, the first filler sequence may be located between the promoter region and enhancer region, and the second filler sequence may be located between the intron region and MCS region. In one embodiment, a viral genome may comprise two filler sequences, the first filler sequence may be located between the promoter region and enhancer region, and the second filler sequence may be located between the intron region and exon region. In one embodiment, a viral genome may comprise two filler sequences, the first filler sequence may be located between the promoter region and enhancer region, and the second filler sequence may be located between the intron region and 3' ITR. In one embodiment, a viral genome may comprise two filler sequences, the first filler sequence may be located between the promoter region and enhancer region, and the second filler sequence may be located between the enhancer region and polyadenylation signal sequence region. In one embodiment, a viral genome may comprise two filler sequences, the first filler sequence may be located between the promoter region and enhancer region, and the second filler sequence may be located between the enhancer region and MCS region. In one embodiment, a viral genome may comprise two filler sequences, the first filler sequence may be located between the promoter region and enhancer region, and the second filler sequence may be located between the enhancer region and exon region. In one embodiment, a viral genome may comprise two filler sequences, the first filler sequence may be located between the promoter region and enhancer region, and the second filler sequence may be located between the enhancer region and 3' ITR. In one embodiment, a viral genome may comprise two filler sequences, the first filler sequence may be located between the promoter region and enhancer region, and the second filler sequence may be located between the polyadenylation signal sequence region and MCS region. In one embodiment, a viral genome may comprise two filler sequences, the first filler sequence may be located between the promoter region and enhancer region, and the second filler sequence may be located between the polyadenylation signal sequence region and exon region. In one embodiment, a viral genome may comprise two filler sequences, the first filler sequence may be located between the promoter region and enhancer region, and the second filler sequence may be located between the polyadenylation signal sequence region and 3' ITR. In one embodiment, a viral genome may comprise two filler sequences, the first filler sequence may be located between the promoter region and enhancer region, and the second filler sequence may be located between the MCS region and exon region. In one embodiment, a viral genome may comprise two filler sequences, the first filler sequence may be located between the promoter region and enhancer region, and the second filler sequence may be located between the MCS region and 3' ITR. In one embodiment, a viral genome may comprise two filler sequences, the first filler sequence may be located between the promoter region and enhancer region, and the second filler sequence may be located between the exon region and 3' ITR.

In one embodiment, a viral genome may comprise two filler sequences, the first filler sequence may be located between the promoter region and polyadenylation signal sequence region, and the second filler sequence may be located between the payload region and intron region. In one embodiment, a viral genome may comprise two filler sequences, the first filler sequence may be located between the promoter region and polyadenylation signal sequence region, and the second filler sequence may be located between the payload region and enhancer region. In one embodiment, a viral genome may comprise two filler sequences, the first filler sequence may be located between the promoter region and polyadenylation signal sequence region, and the second filler sequence may be located between the payload region and polyadenylation signal sequence region. In one embodiment, a viral genome may comprise two filler sequences, the first filler sequence may be located between the promoter region and polyadenylation signal sequence region, and the second filler sequence may be located between the payload region and MCS region. In one embodiment, a viral genome may comprise two filler sequences, the first filler sequence may be located between the promoter region and polyadenylation signal sequence region, and the second filler sequence may be located between the payload region and exon region. In one embodiment, a viral genome may comprise two filler sequences, the first filler sequence may be located between the promoter region and polyadenylation signal sequence region, and the second filler sequence may be located between the payload region and 3' ITR. In one embodiment, a viral genome may comprise two filler sequences, the first filler sequence may be located between the promoter region and polyadenylation signal sequence region, and the second filler sequence may be located between the intron region and enhancer region. In one embodiment, a viral genome may comprise two filler sequences, the first filler sequence may be located between the promoter region and polyadenylation signal sequence region, and the second filler sequence may be located between the intron region and polyadenylation signal sequence region. In one embodiment, a viral genome may comprise two filler sequences, the first filler sequence may be located between the promoter region and polyadenylation signal sequence region, and the second filler sequence may be located between the intron region and MCS region. In one embodiment, a viral genome may comprise two filler sequences, the first filler sequence may be located between the promoter region and polyadenylation signal sequence region, and the second filler sequence may be located between the intron region and exon region. In one embodiment, a viral genome may comprise two filler sequences, the first filler sequence may be located between the promoter region and polyadenylation signal sequence region, and the second filler sequence may be located between the intron region and 3' ITR. In one embodiment, a viral genome may comprise two filler sequences, the first filler sequence may be located between the promoter region and polyadenylation signal sequence region, and the second filler sequence may be located between the enhancer region and polyadenylation signal sequence region. In one embodiment, a viral genome may comprise two filler sequences, the first filler sequence may be located between the promoter region and polyade-nylation signal sequence region, and the second filler sequence may be located between the enhancer region and MCS region. In one embodiment, a viral genome may comprise two filler sequences, the first filler sequence may be located between the promoter region and polyadenylation signal sequence region, and the second filler sequence may be located between the enhancer region and exon region. In one embodiment, a viral genome may comprise two filler sequences, the first filler sequence may be located between the promoter region and polyadenylation signal sequence region, and the second filler sequence may be located between the enhancer region and 3' ITR. In one embodiment, a viral genome may comprise two filler sequences, the first filler sequence may be located between the promoter region and polyadenylation signal sequence region, and the second filler sequence may be located between the polyadenylation signal sequence region and MCS region. In one embodiment, a viral genome may comprise two filler sequences, the first filler sequence may be located between the promoter region and polyadenylation signal sequence region, and the second filler sequence may be located between the polyadenylation signal sequence region and exon region. In one embodiment, a viral genome may comprise two filler sequences, the first filler sequence may be located between the promoter region and polyadenylation signal sequence region, and the second filler sequence may be located between the polyadenylation signal sequence region and 3' ITR. In one embodiment, a viral genome may comprise two filler sequences, the first filler sequence may be located between the promoter region and polyadenylation signal sequence region, and the second filler sequence may be located between the MCS region and exon region. In one embodiment, a viral genome may comprise two filler sequences, the first filler sequence may be located between the promoter region and polyadenylation signal sequence region, and the second filler sequence may be located between the MCS region and 3' ITR. In one embodiment, a viral genome may comprise two filler sequences, the first filler sequence may be located between the promoter region and polyadenylation signal sequence region, and the second filler sequence may be located between the exon region and 3' ITR.

In one embodiment, a viral genome may comprise two filler sequences, the first filler sequence may be located between the promoter region and exon region, and the second filler sequence may be located between the payload region and intron region. In one embodiment, a viral genome may comprise two filler sequences, the first filler sequence may be located between the promoter region and exon region, and the second filler sequence may be located between the payload region and enhancer region. In one embodiment, a viral genome may comprise two filler sequences, the first filler sequence may be located between the promoter region and exon region, and the second filler sequence may be located between the payload region and polyadenylation signal sequence region. In one embodiment, a viral genome may comprise two filler sequences, the first filler sequence may be located between the promoter region and exon region, and the second filler sequence may be located between the payload region and MCS region. In one embodiment, a viral genome may comprise two filler sequences, the first filler sequence may be located between the promoter region and exon region, and the second filler sequence may be located between the payload region and exon region. In one embodiment, a viral genome may comprise two filler sequences, the first filler sequence may be located between the promoter region and exon region, and the second filler sequence may be located between the payload region and 3' ITR. In one embodiment, a viral genome may comprise two filler sequences, the first filler sequence may be located between the promoter region and exon region, and the second filler sequence may be located between the intron region and enhancer region. In one embodiment, a viral genome may comprise two filler sequences, the first filler sequence may be located between the promoter region and exon region, and the second filler sequence may be located between the intron region and polyadenylation signal sequence region. In one embodiment, a viral genome may comprise two filler sequences, the first filler sequence may be located between the promoter region and exon region, and the second filler sequence may be located between the intron region and MCS region. In one embodiment, a viral genome may comprise two filler sequences, the first filler sequence may be located between the promoter region and exon region, and the second filler sequence may be located between the intron region and exon region. In one embodiment, a viral genome may comprise two filler sequences, the first filler sequence may be located between the promoter region and exon region, and the second filler sequence may be located between the intron region and 3' ITR. In one embodiment, a viral genome may comprise two filler sequences, the first filler sequence may be located between the promoter region and exon region, and the second filler sequence may be located between the enhancer region and polyadenylation signal sequence region. In one embodiment, a viral genome may comprise two filler sequences, the first filler sequence may be located between the promoter region and exon region, and the second filler sequence may be located between the enhancer region and MCS region. In one embodiment, a viral genome may comprise two filler sequences, the first filler sequence may be located between the promoter region and exon region, and the second filler sequence may be located between the enhancer region and exon region. In one embodiment, a viral genome may comprise two filler sequences, the first filler sequence may be located between the promoter region and exon region, and the second filler sequence may be located between the enhancer region and 3' ITR. In one embodiment, a viral genome may comprise two filler sequences, the first filler sequence may be located between the promoter region and exon region, and the second filler sequence may be located between the polyadenylation signal sequence region and MCS region. In one embodiment, a viral genome may comprise two filler sequences, the first filler sequence may be located between the promoter region and exon region, and the second filler sequence may be located between the polyadenylation signal sequence region and exon region. In one embodiment, a viral genome may comprise two filler sequences, the first filler sequence may be located between the promoter region and exon region, and the second filler sequence may be located between the polyadenylation signal sequence region and 3' ITR. In one embodiment, a viral genome may comprise two filler sequences, the first filler sequence may be located between the promoter region and exon region, and the second filler sequence may be located between the MCS region and exon region. In one embodiment, a viral genome may comprise two filler sequences, the first filler sequence may be located between the promoter region and exon region, and the second filler sequence may be located between the MCS region and 3' ITR. In one embodiment, a viral genome may comprise two filler sequences, the first filler sequence may be located between the promoter region and exon region, and the second filler sequence may be located between the exon region and 3' ITR.

In one embodiment, a viral genome may comprise two filler sequences, the first filler sequence may be located between the promoter region and MCS region, and the second filler sequence may be located between the payload region and intron region. In one embodiment, a viral genome may comprise two filler sequences, the first filler sequence may be located between the promoter region and MCS region, and the second filler sequence may be located between the payload region and enhancer region. In one embodiment, a viral genome may comprise two filler sequences, the first filler sequence may be located between the promoter region and MCS region, and the second filler sequence may be located between the payload region and polyadenylation signal sequence region. In one embodiment, a viral genome may comprise two filler sequences, the first filler sequence may be located between the promoter region and MCS region, and the second filler sequence may be located between the payload region and MCS region. In one embodiment, a viral genome may comprise two filler sequences, the first filler sequence may be located between the promoter region and MCS region, and the second filler sequence may be located between the payload region and exon region. In one embodiment, a viral genome may comprise two filler sequences, the first filler sequence may be located between the promoter region and MCS region, and the second filler sequence may be located between the payload region and 3' ITR. In one embodiment, a viral genome may comprise two filler sequences, the first filler sequence may be located between the promoter region and MCS region, and the second filler sequence may be located between the intron region and enhancer region. In one embodiment, a viral genome may comprise two filler sequences, the first filler sequence may be located between the promoter region and MCS region, and the second filler sequence may be located between the intron region and polyadenylation signal sequence region. In one embodiment, a viral genome may comprise two filler sequences, the first filler sequence may be located between the promoter region and MCS region, and the second filler sequence may be located between the intron region and MCS region. In one embodiment, a viral genome may comprise two filler sequences, the first filler sequence may be located between the promoter region and MCS region, and the second filler sequence may be located between the intron region and exon region. In one embodiment, a viral genome may comprise two filler sequences, the first filler sequence may be located between the promoter region and MCS region, and the second filler sequence may be located between the intron region and 3' ITR. In one embodiment, a viral genome may comprise two filler sequences, the first filler sequence may be located between the promoter region and MCS region, and the second filler sequence may be located between the enhancer region and polyadenylation signal sequence region. In one embodiment, a viral genome may comprise two filler sequences, the first filler sequence may be located between the promoter region and MCS region, and the second filler sequence may be located between the enhancer region and MCS region. In one embodiment, a viral genome may comprise two filler sequences, the first filler sequence may be located between the promoter region and MCS region, and the second filler sequence may be located between the enhancer region and exon region. In one embodiment, a viral genome may comprise two filler sequences, the first filler sequence may be located between the promoter region and MCS region, and the second filler sequence may be located between the enhancer region and 3' ITR. In one embodiment, a viral genome may comprise two filler sequences, the first filler sequence may be located between the promoter region and MCS region, and the second filler sequence may be located between the polyadenylation signal sequence region and MCS region. In one embodiment, a viral genome may comprise two filler sequences, the first filler sequence may be located between the promoter region and MCS region, and the second filler sequence may be located between the polyadenylation signal sequence region and exon region. In one embodiment, a viral genome may comprise two filler sequences, the first filler sequence may be located between the promoter region and MCS region, and the second filler sequence may be located between the polyadenylation signal sequence region and 3' ITR. In one embodiment, a viral genome may comprise two filler sequences, the first filler sequence may be located between the promoter region and MCS region, and the second filler sequence may be located between the MCS region and exon region. In one embodiment, a viral genome may comprise two filler sequences, the first filler sequence may be located between the promoter region and MCS region, and the second filler sequence may be located between the MCS region and 3' ITR. In one embodiment, a viral genome may comprise two filler sequences, the first filler sequence may be located between the promoter region and MCS region, and the second filler sequence may be located between the exon region and 3' ITR.

In one embodiment, a viral genome may comprise two filler sequences, the first filler sequence may be located between the promoter region and 3'ITR, and the second filler sequence may be located between the payload region and intron region. In one embodiment, a viral genome may comprise two filler sequences, the first filler sequence may be located between the promoter region and 3'ITR, and the second filler sequence may be located between the payload region and enhancer region. In one embodiment, a viral genome may comprise two filler sequences, the first filler sequence may be located between the promoter region and 3'ITR, and the second filler sequence may be located between the payload region and polyadenylation signal sequence region. In one embodiment, a viral genome may comprise two filler sequences, the first filler sequence may be located between the promoter region and 3'ITR, and the second filler sequence may be located between the payload region and MCS region. In one embodiment, a viral genome may comprise two filler sequences, the first filler sequence may be located between the promoter region and 3'ITR, and the second filler sequence may be located between the payload region and exon region. In one embodiment, a viral genome may comprise two filler sequences, the first filler sequence may be located between the promoter region and 3'ITR, and the second filler sequence may be located between the payload region and 3' ITR. In one embodiment, a viral genome may comprise two filler sequences, the first filler sequence may be located between the promoter region and 3'ITR, and the second filler sequence may be located between the intron region and enhancer region. In one embodiment, a viral genome may comprise two filler sequences, the first filler sequence may be located between the promoter region and 3'ITR, and the second filler sequence may be located between the intron region and polyadenylation signal sequence region. In one embodiment, a viral genome may comprise two filler sequences, the first filler sequence may be located between the promoter region and 3'ITR, and the second filler sequence may be located between the intron region and MCS region. In one embodiment, a viral genome may comprise two filler sequences, the first filler sequence may be located between the promoter region and 3'ITR, and the second filler sequence may be located between the intron region and exon region. In one embodiment, a viral genome may comprise two filler sequences, the first filler sequence may be located between the promoter region and 3'ITR, and the second filler sequence may be located between the intron region and 3' ITR. In one embodiment, a viral genome may comprise two filler sequences, the first filler sequence may be located between the promoter region and 3'ITR, and the second filler sequence may be located between the enhancer region and polyadenylation signal sequence region. In one embodiment, a viral genome may comprise two filler sequences, the first filler sequence may be located between the promoter region and 3'ITR, and the second filler sequence may be located between the enhancer region and MCS region. In one embodiment, a viral genome may comprise two filler sequences, the first filler sequence may be located between the promoter region and 3'ITR, and the second filler sequence may be located between the enhancer region and exon region. In one embodiment, a viral genome may comprise two filler sequences, the first filler sequence may be located between the promoter region and 3'ITR, and the second filler sequence may be located between the enhancer region and 3' ITR. In one embodiment, a viral genome may comprise two filler sequences, the first filler sequence may be located between the promoter region and 3'ITR, and the second filler sequence may be located between the polyadenylation signal sequence region and MCS region. In one embodiment, a viral genome may comprise two filler sequences, the first filler sequence may be located between the promoter region and 3'ITR, and the second filler sequence may be located between the polyadenylation signal sequence region and exon region. In one embodiment, a viral genome may comprise two filler sequences, the first filler sequence may be located between the promoter region and 3'ITR, and the second filler sequence may be located between the polyadenylation signal sequence region and 3' ITR. In one embodiment, a viral genome may comprise two filler sequences, the first filler sequence may be located between the promoter region and 3'ITR, and the second filler sequence may be located between the MCS region and exon region. In one embodiment, a viral genome may comprise two filler sequences, the first filler sequence may be located between the promoter region and 3'ITR, and the second filler sequence may be located between the MCS region and 3' ITR. In one embodiment, a viral genome may comprise two filler sequences, the first filler sequence may be located between the promoter region and 3'ITR, and the second filler sequence may be located between the exon region and 3' ITR.

In one embodiment, a viral genome may comprise two filler sequences, the first filler sequence may be located between the payload region and intron region, and the second filler sequence may be located between the intron region and enhancer region. In one embodiment, a viral genome may comprise two filler sequences, the first filler sequence may be located between the payload region and intron region, and the second filler sequence may be located between the intron region and polyadenylation signal sequence region. In one embodiment, a viral genome may comprise two filler sequences, the first filler sequence may be located between the payload region and intron region, and the second filler sequence may be located between the intron region and MCS region. In one embodiment, a viral genome may comprise two filler sequences, the first filler sequence may be located between the payload region and intron region, and the second filler sequence may be located between the intron region and exon region. In one embodiment, a viral genome may comprise two filler sequences, the first filler sequence may be located between the payload region and intron region, and the second filler sequence may be located between the intron region and 3' ITR. In one embodiment, a viral genome may comprise two filler sequences, the first filler sequence may be located between the payload region and intron region, and the second filler sequence may be located between the enhancer region and polyadenylation signal sequence region. In one embodiment, a viral genome may comprise two filler sequences, the first filler sequence may be located between the payload region and intron region, and the second filler sequence may be located between the enhancer region and MCS region. In one embodiment, a viral genome may comprise two filler sequences, the first filler sequence may be located between the payload region and intron region, and the second filler sequence may be located between the enhancer region and exon region. In one embodiment, a viral genome may comprise two filler sequences, the first filler sequence may be located between the payload region and intron region, and the second filler sequence may be located between the enhancer region and 3' ITR. In one embodiment, a viral genome may comprise two filler sequences, the first filler sequence may be located between the payload region and intron region, and the second filler sequence may be located between the polyadenylation signal sequence region and MCS region. In one embodiment, a viral genome may comprise two filler sequences, the first filler sequence may be located between the payload region and intron region, and the second filler sequence may be located between the polyadenylation signal sequence region and exon region. In one embodiment, a viral genome may comprise two filler sequences, the first filler sequence may be located between the payload region and intron region, and the second filler sequence may be located between the polyadenylation signal sequence region and 3' ITR. In one embodiment, a viral genome may comprise two filler sequences, the first filler sequence may be located between the payload region and intron region, and the second filler sequence may be located between the MCS region and exon region. In one embodiment, a viral genome may comprise two filler sequences, the first filler sequence may be located between the payload region and intron region, and the second filler sequence may be located between the MCS region and 3' ITR. In one embodiment, a viral genome may comprise two filler sequences, the first filler sequence may be located between the payload region and intron region, and the second filler sequence may be located between the exon region and 3' ITR.

In one embodiment, a viral genome may comprise two filler sequences, the first filler sequence may be located between the payload region and enhancer region, and the second filler sequence may be located between the intron region and enhancer region. In one embodiment, a viral genome may comprise two filler sequences, the first filler sequence may be located between the payload region and enhancer region, and the second filler sequence may be located between the intron region and polyadenylation signal sequence region. In one embodiment, a viral genome may comprise two filler sequences, the first filler sequence may be located between the payload region and enhancer region, and the second filler sequence may be located between the intron region and MCS region. In one embodiment, a viral genome may comprise two filler sequences, the first filler sequence may be located between the payload region and enhancer region, and the second filler sequence may be located between the intron region and exon region. In one embodiment, a viral genome may comprise two filler sequences, the first filler sequence may be located between the payload region and enhancer region, and the second filler sequence may be located between the intron region and 3' ITR. In one embodiment, a viral genome may comprise two filler sequences, the first filler sequence may be located between the payload region and enhancer region, and the second filler sequence may be located between the enhancer region and polyadenylation signal sequence region. In one embodiment, a viral genome may comprise two filler sequences, the first filler sequence may be located between the payload region and enhancer region, and the second filler sequence may be located between the enhancer region and MCS region. In one embodiment, a viral genome may comprise two filler sequences, the first filler sequence may be located between the payload region and enhancer region, and the second filler sequence may be located between the enhancer region and exon region. In one embodiment, a viral genome may comprise two filler sequences, the first filler sequence may be located between the payload region and enhancer region, and the second filler sequence may be located between the enhancer region and 3' ITR. In one embodiment, a viral genome may comprise two filler sequences, the first filler sequence may be located between the payload region and enhancer region, and the second filler sequence may be located between the polyadenylation signal sequence region and MCS region. In one embodiment, a viral genome may comprise two filler sequences, the first filler sequence may be located between the payload region and enhancer region, and the second filler sequence may be located between the polyadenylation signal sequence region and exon region. In one embodiment, a viral genome may comprise two filler sequences, the first filler sequence may be located between the payload region and enhancer region, and the second filler sequence may be located between the polyadenylation signal sequence region and 3' ITR. In one embodiment, a viral genome may comprise two filler sequences, the first filler sequence may be located between the payload region and enhancer region, and the second filler sequence may be located between the MCS region and exon region. In one embodiment, a viral genome may comprise two filler sequences, the first filler sequence may be located between the payload region and enhancer region, and the second filler sequence may be located between the MCS region and 3' ITR. In one embodiment, a viral genome may comprise two filler sequences, the first filler sequence may be located between the payload region and enhancer region, and the second filler sequence may be located between the exon region and 3' ITR.

In one embodiment, a viral genome may comprise two filler sequences, the first filler sequence may be located between the payload region and polyadenylation signal sequence region, and the second filler sequence may be located between the intron region and enhancer region. In one embodiment, a viral genome may comprise two filler sequences, the first filler sequence may be located between the payload region and polyadenylation signal sequence region, and the second filler sequence may be located between the intron region and polyadenylation signal sequence region. In one embodiment, a viral genome may comprise two filler sequences, the first filler sequence may be located between the payload region and polyadenylation signal sequence region, and the second filler sequence may be located between the intron region and MCS region. In one embodiment, a viral genome may comprise two filler sequences, the first filler sequence may be located between the payload region and polyadenylation signal sequence region, and the second filler sequence may be located between the intron region and exon region. In one embodiment, a viral genome may comprise two filler sequences, the first filler sequence may be located between the payload region and polyadenylation signal sequence region, and the second filler sequence may be located between the intron region and 3' ITR. In one embodiment, a viral genome may comprise two filler sequences, the first filler sequence may be located between the payload region and polyadenylation signal sequence region, and the second filler sequence may be located between the enhancer region and polyadenylation signal sequence region. In one embodiment, a viral genome may comprise two filler sequences, the first filler sequence may be located between the payload region and polyadenylation signal sequence region, and the second filler sequence may be located between the enhancer region and MCS region. In one embodiment, a viral genome may comprise two filler sequences, the first filler sequence may be located between the payload region and polyadenylation signal sequence region, and the second filler sequence may be located between the enhancer region and exon region. In one embodiment, a viral genome may comprise two filler sequences, the first filler sequence may be located between the payload region and polyadenylation signal sequence region, and the second filler sequence may be located between the enhancer region and 3' ITR. In one embodiment, a viral genome may comprise two filler sequences, the first filler sequence may be located between the payload region and polyadenylation signal sequence region, and the second filler sequence may be located between the polyadenylation signal sequence region and MCS region. In one embodiment, a viral genome may comprise two filler sequences, the first filler sequence may be located between the payload region and polyadenylation signal sequence region, and the second filler sequence may be located between the polyadenylation signal sequence region and exon region. In one embodiment, a viral genome may comprise two filler sequences, the first filler sequence may be located between the payload region and polyadenylation signal sequence region, and the second filler sequence may be located between the polyadenylation signal sequence region and 3' ITR. In one embodiment, a viral genome may comprise two filler sequences, the first filler sequence may be located between the payload region and polyadenylation signal sequence region, and the second filler sequence may be located between the MCS region and exon region. In one embodiment, a viral genome may comprise two filler sequences, the first filler sequence may be located between the payload region and polyadenylation signal sequence region, and the second filler sequence may be located between the MCS region and 3' ITR. In one embodiment, a viral genome may comprise two filler sequences, the first filler sequence may be located between the payload region and polyadenylation signal sequence region, and the second filler sequence may be located between the exon region and 3' ITR.

In one embodiment, a viral genome may comprise two filler sequences, the first filler sequence may be located between the payload region and MCS region, and the second filler sequence may be located between the intron region and enhancer region. In one embodiment, a viral genome may comprise two filler sequences, the first filler sequence may be located between the payload region and MCS region, and the second filler sequence may be located between the intron region and polyadenylation signal sequence region. In one embodiment, a viral genome may comprise two filler sequences, the first filler sequence may be located between the payload region and MCS region, and the second filler sequence may be located between the intron region and MCS region. In one embodiment, a viral genome may comprise two filler sequences, the first filler sequence may be located between the payload region and MCS region, and the second filler sequence may be located between the intron region and exon region. In one embodiment, a viral genome may comprise two filler sequences, the first filler sequence may be located between the payload region and MCS region, and the second filler sequence may be located between the intron region and 3' ITR. In one embodiment, a viral genome may comprise two filler sequences, the first filler sequence may be located between the payload region and MCS region, and the second filler sequence may be located between the enhancer region and polyadenylation signal sequence region. In one embodiment, a viral genome may comprise two filler sequences, the first filler sequence may be located between the payload region and MCS region, and the second filler sequence may be located between the enhancer region and MCS region. In one embodiment, a viral genome may comprise two filler sequences, the first filler sequence may be located between the payload region and MCS region, and the second filler sequence may be located between the enhancer region and exon region. In one embodiment, a viral genome may comprise two filler sequences, the first filler sequence may be located between the payload region and MCS region, and the second filler sequence may be located between the enhancer region and 3' ITR. In one embodiment, a viral genome may comprise two filler sequences, the first filler sequence may be located between the payload region and MCS region, and the second filler sequence may be located between the polyadenylation signal sequence region and MCS region. In one embodiment, a viral genome may comprise two filler sequences, the first filler sequence may be located between the payload region and MCS region, and the second filler sequence may be located between the polyadenylation signal sequence region and exon region. In one embodiment, a viral genome may comprise two filler sequences, the first filler sequence may be located between the payload region and MCS region, and the second filler sequence may be located between the polyadenylation signal sequence region and 3' ITR. In one embodiment, a viral genome may comprise two filler sequences, the first filler sequence may be located between the payload region and MCS region, and the second filler sequence may be located between the MCS region and exon region. In one embodiment, a viral genome may comprise two filler sequences, the first filler sequence may be located between the payload region and MCS region, and the second filler sequence may be located between the MCS region and 3' ITR. In one embodiment, a viral genome may comprise two filler sequences, the first filler sequence may be located between the payload region and MCS region, and the second filler sequence may be located between the exon region and 3' ITR.

In one embodiment, a viral genome may comprise two filler sequences, the first filler sequence may be located between the payload region and exon region, and the second filler sequence may be located between the intron region and enhancer region. In one embodiment, a viral genome may comprise two filler sequences, the first filler sequence may be located between the payload region and exon region, and the second filler sequence may be located between the intron region and polyadenylation signal sequence region. In one embodiment, a viral genome may comprise two filler sequences, the first filler sequence may be located between the payload region and exon region, and the second filler sequence may be located between the intron region and MCS region. In one embodiment, a viral genome may comprise two filler sequences, the first filler sequence may be located between the payload region and exon region, and the second filler sequence may be located between the intron region and exon region. In one embodiment, a viral genome may comprise two filler sequences, the first filler sequence may be located between the payload region and exon region, and the second filler sequence may be located between the intron region and 3' ITR. In one embodiment, a viral genome may comprise two filler sequences, the first filler sequence may be located between the payload region and exon region, and the second filler sequence may be located between the enhancer region and polyadenylation signal sequence region. In one embodiment, a viral genome may comprise two filler sequences, the first filler sequence may be located between the payload region and exon region, and the second filler sequence may be located between the enhancer region and MCS region. In one embodiment, a viral genome may comprise two filler sequences, the first filler sequence may be located between the payload region and exon region, and the second filler sequence may be located between the enhancer region and exon region. In one embodiment, a viral genome may comprise two filler sequences, the first filler sequence may be located between the payload region and exon region, and the second filler sequence may be located between the enhancer region and 3' ITR. In one embodiment, a viral genome may comprise two filler sequences, the first filler sequence may be located between the payload region and exon region, and the second filler sequence may be located between the polyadenylation signal sequence region and MCS region. In one embodiment, a viral genome may comprise two filler sequences, the first filler sequence may be located between the payload region and exon region, and the second filler sequence may be located between the polyadenylation signal sequence region and exon region. In one embodiment, a viral genome may comprise two filler sequences, the first filler sequence may be located between the payload region and exon region, and the second filler sequence may be located between the polyadenylation signal sequence region and 3' ITR. In one embodiment, a viral genome may comprise two filler sequences, the first filler sequence may be located between the payload region and exon region, and the second filler sequence may be located between the MCS region and exon region. In one embodiment, a viral genome may comprise two filler sequences, the first filler sequence may be located between the payload region and exon region, and the second filler sequence may be located between the MCS region and 3' ITR. In one embodiment, a viral genome may comprise two filler sequences, the first filler sequence may be located between the payload region and exon region, and the second filler sequence may be located between the exon region and 3' ITR.

In one embodiment, a viral genome may comprise two filler sequences, the first filler sequence may be located between the payload region and 3' ITR region, and the second filler sequence may be located between the intron region and enhancer region. In one embodiment, a viral genome may comprise two filler sequences, the first filler sequence may be located between the payload region and 3' ITR region, and the second filler sequence may be located between the intron region and polyadenylation signal sequence region. In one embodiment, a viral genome may comprise two filler sequences, the first filler sequence may be located between the payload region and 3' ITR region, and the second filler sequence may be located between the intron region and MCS region. In one embodiment, a viral genome may comprise two filler sequences, the first filler sequence may be located between the payload region and 3' ITR region, and the second filler sequence may be located between the intron region and exon region. In one embodiment, a viral genome may comprise two filler sequences, the first filler sequence may be located between the payload region and 3' ITR region, and the second filler sequence may be located between the intron region and 3' ITR. In one embodiment, a viral genome may comprise two filler sequences, the first filler sequence may be located between the payload region and 3' ITR region, and the second filler sequence may be located between the enhancer region and polyadenylation signal sequence region. In one embodiment, a viral genome may comprise two filler sequences, the first filler sequence may be located between the payload region and 3' ITR region, and the second filler sequence may be located between the enhancer region and MCS region. In one embodiment, a viral genome may comprise two filler sequences, the first filler sequence may be located between the payload region and 3' ITR region, and the second filler sequence may be located between the enhancer region and exon region. In one embodiment, a viral genome may comprise two filler sequences, the first filler sequence may be located between the payload region and 3' ITR region, and the second filler sequence may be located between the enhancer region and 3' ITR. In one embodiment, a viral genome may comprise two filler sequences, the first filler sequence may be located between the payload region and 3' ITR region, and the second filler sequence may be located between the polyadenylation signal sequence region and MCS region. In one embodiment, a viral genome may comprise two filler sequences, the first filler sequence may be located between the payload region and 3' ITR region, and the second filler sequence may be located between the polyadenylation signal sequence region and exon region. In one embodiment, a viral genome may comprise two filler sequences, the first filler sequence may be located between the payload region and 3' ITR region, and the second filler sequence may be located between the polyadenylation signal sequence region and 3' ITR. In one embodiment, a viral genome may comprise two filler sequences, the first filler sequence may be located between the payload region and 3' ITR region, and the second filler sequence may be located between the MCS region and exon region. In one embodiment, a viral genome may comprise two filler sequences, the first filler sequence may be located between the payload region and 3' ITR region, and the second filler sequence may be located between the MCS region and 3' ITR. In one embodiment, a viral genome may comprise two filler sequences, the first filler sequence may be located between the payload region and 3' ITR region, and the second filler sequence may be located between the exon region and 3' ITR.

In one embodiment, a viral genome may comprise two filler sequences, the first filler sequence may be located between the intron region and enhancer region, and the second filler sequence may be located between the enhancer region and polyadenylation signal sequence region. In one embodiment, a viral genome may comprise two filler sequences, the first filler sequence may be located between the intron region and enhancer region, and the second filler sequence may be located between the enhancer region and MCS region. In one embodiment, a viral genome may comprise two filler sequences, the first filler sequence may be located between the intron region and enhancer region, and the second filler sequence may be located between the enhancer region and exon region. In one embodiment, a viral genome may comprise two filler sequences, the first filler sequence may be located between the intron region and enhancer region, and the second filler sequence may be located between the enhancer region and 3' ITR. In one embodiment, a viral genome may comprise two filler sequences, the first filler sequence may be located between the intron region and enhancer region, and the second filler sequence may be located between the polyadenylation signal sequence region and MCS region. In one embodiment, a viral genome may comprise two filler sequences, the first filler sequence may be located between the intron region and enhancer region, and the second filler sequence may be located between the polyadenylation signal sequence region and exon region. In one embodiment, a viral genome may comprise two filler sequences, the first filler sequence may be located between the intron region and enhancer region, and the second filler sequence may be located between the polyadenylation signal sequence region and 3' ITR. In one embodiment, a viral genome may comprise two filler sequences, the first filler sequence may be located between the intron region and enhancer region, and the second filler sequence may be located between the MCS region and exon region. In one embodiment, a viral genome may comprise two filler sequences, the first filler sequence may be located between the intron region and enhancer region, and the second filler sequence may be located between the MCS region and 3' ITR. In one embodiment, a viral genome may comprise two filler sequences, the first filler sequence may be located between the intron region and enhancer region, and the second filler sequence may be located between the exon region and 3' ITR.

In one embodiment, a viral genome may comprise two filler sequences, the first filler sequence may be located between the intron region and polyadenylation signal sequence region, and the second filler sequence may be located between the enhancer region and polyadenylation signal sequence region. In one embodiment, a viral genome may comprise two filler sequences, the first filler sequence may be located between the intron region and polyadenylation signal sequence region, and the second filler sequence may be located between the enhancer region and MCS region. In one embodiment, a viral genome may comprise two filler sequences, the first filler sequence may be located between the intron region and polyadenylation signal sequence region, and the second filler sequence may be located between the enhancer region and exon region. In one embodiment, a viral genome may comprise two filler sequences, the first filler sequence may be located between the intron region and polyadenylation signal sequence region, and the second filler sequence may be located between the enhancer region and 3' ITR. In one embodiment, a viral genome may comprise two filler sequences, the first filler sequence may be located between the intron region and polyadenylation signal sequence region, and the second filler sequence may be located between the polyadenylation signal sequence region and MCS region. In one embodiment, a viral genome may comprise two filler sequences, the first filler sequence may be located between the intron region and polyadenylation signal sequence region, and the second filler sequence may be located between the polyadenylation signal sequence region and exon region. In one embodiment, a viral genome may comprise two filler sequences, the first filler sequence may be located between the intron region and polyadenylation signal sequence region, and the second filler sequence may be located between the polyadenylation signal sequence region and 3' ITR. In one embodiment, a viral genome may comprise two filler sequences, the first filler sequence may be located between the intron region and pol adenylation signal sequence region, and the second filler sequence may be located between the MCS region and exon region. In one embodiment, a viral genome may comprise two filler sequences, the first filler sequence may be located between the intron region and polyadenylation signal sequence region, and the second filler sequence may be located between the MCS region and 3' ITR. In one embodiment, a viral genome may comprise two filler sequences, the first filler sequence may be located between the intron region and polyadenylation signal sequence region, and the second filler sequence may be located between the exon region and 3' ITR.

In one embodiment, a viral genome may comprise two filler sequences, the first filler sequence may be located between the intron region and MCS region, and the second filler sequence may be located between the enhancer region and polyadenylation signal sequence region. In one embodiment, a viral genome may comprise two filler sequences, the first filler sequence may be located between the intron region and MCS region, and the second filler sequence may be located between the enhancer region and MCS region. In one embodiment, a viral genome may comprise two filler sequences, the first filler sequence may be located between the intron region and MCS region, and the second filler sequence may be located between the enhancer region and exon region. In one embodiment, a viral genome may comprise two filler sequences, the first filler sequence may be located between the intron region and MCS region, and the second filler sequence may be located between the enhancer region and 3' ITR. In one embodiment, a viral genome may comprise two filler sequences, the first filler sequence may be located between the intron region and MCS region, and the second filler sequence may be located between the polyadenylation signal sequence region and MCS region. In one embodiment, a viral genome may comprise two filler sequences, the first filler sequence may be located between the intron region and MCS region, and the second filler sequence may be located between the polyadenylation signal sequence region and exon region. In one embodiment, a viral genome may comprise two filler sequences, the first filler sequence may be located between the intron region and MCS region, and the second filler sequence may be located between the polyadenylation signal sequence region and 3' ITR. In one embodiment, a viral genome may comprise two filler sequences, the first filler sequence may be located between the intron region and MCS region, and the second filler sequence may be located between the MCS region and exon region. In one embodiment, a viral genome may comprise two filler sequences, the first filler sequence may be located between the intron region and MCS region, and the second filler sequence may be located between the MCS region and 3' ITR. In one embodiment, a viral genome may comprise two filler sequences, the first filler sequence may be located between the intron region and MCS region, and the second filler sequence may be located between the exon region and 3' ITR.

In one embodiment, a viral genome may comprise two filler sequences, the first filler sequence may be located between the intron region and exon region, and the second filler sequence may be located between the enhancer region and polyadenylation signal sequence region. In one embodiment, a viral genome may comprise two filler sequences, the first filler sequence may be located between the intron region and exon region, and the second filler sequence may be located between the enhancer region and MCS region. In one embodiment, a viral genome may comprise two filler sequences, the first filler sequence may be located between the intron region and exon region, and the second filler sequence may be located between the enhancer region and exon region. In one embodiment, a viral genome may comprise two filler sequences, the first filler sequence may be located between the intron region and exon region, and the second filler sequence may be located between the enhancer region and 3' ITR. In one embodiment, a viral genome may comprise two filler sequences, the first filler sequence may be located between the intron region and exon region, and the second filler sequence may be located between the polyadenylation signal sequence region and MCS region. In one embodiment, a viral genome may comprise two filler sequences, the first filler sequence may be located between the intron region and exon region, and the second filler sequence may be located between the polyadenylation signal sequence region and exon region. In one embodiment, a viral genome may comprise two filler sequences, the first filler sequence may be located between the intron region and exon region, and the second filler sequence may be located between the polyadenylation signal sequence region and 3' ITR. In one embodiment, a viral genome may comprise two filler sequences, the first filler sequence may be located between the intron region and exon region, and the second filler sequence may be located between the MCS region and exon region. In one embodiment, a viral genome may comprise two filler sequences, the first filler sequence may be located between the intron region and exon region, and the second filler sequence may be located between the MCS region and 3' ITR. In one embodiment, a viral genome may comprise two filler sequences, the first filler sequence may be located between the intron region and exon region, and the second filler sequence may be located between the exon region and 3' ITR.

In one embodiment, a viral genome may comprise two filler sequences, the first filler sequence may be located between the intron region and 3'ITR, and the second filler sequence may be located between the enhancer region and polyadenylation signal sequence region. In one embodiment, a viral genome may comprise two filler sequences, the first filler sequence may be located between the intron region and 3'ITR, and the second filler sequence may be located between the enhancer region and MCS region. In one embodiment, a viral genome may comprise two filler sequences, the first filler sequence may be located between the intron region and 3'ITR, and the second filler sequence may be located between the enhancer region and exon region. In one embodiment, a viral genome may comprise two filler sequences, the first filler sequence may be located between the intron region and 3'ITR, and the second filler sequence may be located between the enhancer region and 3' ITR. In one embodiment, a viral genome may comprise two filler sequences, the first filler sequence may be located between the intron region and 3'ITR, and the second filler sequence may be located between the polyadenylation signal sequence region and MCS region. In one embodiment, a viral genome may comprise two filler sequences, the first filler sequence may be located between the intron region and 3'ITR, and the second filler sequence may be located between the polyadenylation signal sequence region and exon region. In one embodiment, a viral genome may comprise two filler sequences, the first filler sequence may be located between the intron region and 3'ITR, and the second filler sequence may be located between the polyadenylation signal sequence region and 3' ITR. In one embodiment, a viral genome may comprise two filler sequences, the first filler sequence may be located between the intron region and 3'ITR, and the second filler sequence may be located between the MCS region and exon region. In one embodiment, a viral genome may comprise two filler sequences, the first filler sequence may be located between the intron region and 3'ITR, and the second filler sequence may be located between the MCS region and 3' ITR. In one embodiment, a viral genome may comprise two filler sequences, the first filler sequence may be located between the intron region and 3'ITR, and the second filler sequence may be located between the exon region and 3' ITR.

In one embodiment, a viral genome may comprise two filler sequences, the first filler sequence may be located between the enhancer region and polyadenylation signal sequence region, and the second filler sequence may be located between the polyadenylation signal sequence region and MCS region. In one embodiment, a viral genome may comprise two filler sequences, the first filler sequence may be located between the enhancer region and polyadenylation signal sequence region, and the second filler sequence may be located between the polyadenylation signal sequence region and exon region. In one embodiment, a viral genome may comprise two filler sequences, the first filler sequence may be located between the enhancer region and polyadenylation signal sequence region, and the second filler sequence may be located between the polyadenylation signal sequence region and 3' ITR. In one embodiment, a viral genome may comprise two filler sequences, the first filler sequence may be located between the enhancer region and polyadenylation signal sequence region, and the second filler sequence may be located between the MCS region and exon region. In one embodiment, a viral genome may comprise two filler sequences, the first filler sequence may be located between the enhancer region and polyadenylation signal sequence region, and the second filler sequence may be located between the MCS region and 3' ITR. In one embodiment, a viral genome may comprise two filler sequences, the first filler sequence may be located between the enhancer region and polyadenylation signal sequence region, and the second filler sequence may be located between the exon region and 3' ITR.

In one embodiment, a viral genome may comprise two filler sequences, the first filler sequence may be located between the enhancer region and MCS region, and the second filler sequence may be located between the polyadenylation signal sequence region and MCS region. In one embodiment, a viral genome may comprise two filler sequences, the first filler sequence may be located between the enhancer region and MCS region, and the second filler sequence may be located between the polyadenylation signal sequence region and exon region. In one embodiment, a viral genome may comprise two filler sequences, the first filler sequence may be located between the enhancer region and MCS region, and the second filler sequence may be located between the polyadenylation signal sequence region and 3' ITR. In one embodiment, a viral genome may comprise two filler sequences, the first filler sequence may be located between the enhancer region and MCS region, and the second filler sequence may be located between the MCS region and exon region. In one embodiment, a viral genome may comprise two filler sequences, the first filler sequence may be located between the enhancer region and MCS region, and the second filler sequence may be located between the MCS region and 3' ITR. In one embodiment, a viral genome may comprise two filler sequences, the first filler sequence may be located between the enhancer region and MCS region, and the second filler sequence may be located between the exon region and 3' ITR.

In one embodiment, a viral genome may comprise two filler sequences, the first filler sequence may be located between the enhancer region and exon region, and the second filler sequence may be located between the polyadenylation signal sequence region and MCS region. In one embodiment, a viral genome may comprise two filler sequences, the first filler sequence may be located between the enhancer region and exon region, and the second filler sequence may be located between the polyadenylation signal sequence region and exon region. In one embodiment, a viral genome may comprise two filler sequences, the first filler sequence may be located between the enhancer region and exon region, and the second filler sequence may be located between the polyadenylation signal sequence region and 3' ITR. In one embodiment, a viral genome may comprise two filler sequences, the first filler sequence may be located between the enhancer region and exon region, and the second filler sequence may be located between the MCS region and exon region. In one embodiment, a viral genome may comprise two filler sequences, the first filler sequence may be located between the enhancer region and exon region, and the second filler sequence may be located between the MCS region and 3' ITR. In one embodiment, a viral genome may comprise two filler sequences, the first filler sequence may be located between the enhancer region and exon region, and the second filler sequence may be located between the exon region and 3' ITR.

In one embodiment, a viral genome may comprise two filler sequences, the first filler sequence may be located between the enhancer region and 3' ITR, and the second filler sequence may be located between the polyadenylation signal sequence region and MCS region. In one embodiment, a viral genome may comprise two filler sequences, the first filler sequence may be located between the enhancer region and 3' ITR, and the second filler sequence may be located between the polyadenylation signal sequence region and exon region. In one embodiment, a viral genome may comprise two filler sequences, the first filler sequence may be located between the enhancer region and 3' ITR, and the second filler sequence may be located between the polyadenylation signal sequence region and 3' ITR. In one embodiment, a viral genome may comprise two filler sequences, the first filler sequence may be located between the enhancer region and 3' ITR, and the second filler sequence may be located between the MCS region and exon region. In one embodiment, a viral genome may comprise two filler sequences, the first filler sequence may be located between the enhancer region and 3' ITR, and the second filler sequence may be located between the MCS region and 3' ITR. In one embodiment, a viral genome may comprise two filler sequences, the first filler sequence may be located between the enhancer region and 3' ITR, and the second filler sequence may be located between the exon region and 3' ITR.

In one embodiment, a viral genome may comprise two filler sequences, the first filler sequence may be located between the polyadenylation signal sequence region and MCS region, and the second filler sequence may be located between the MCS region and exon region. In one embodiment, a viral genome may comprise two filler sequences, the first filler sequence may be located between the polyadenylation signal sequence region and MCS region, and the second filler sequence may be located between the MCS region and 3' ITR. In one embodiment, a viral genome may comprise two filler sequences, the first filler sequence may be located between the polyadenylation signal sequence region and MCS region, and the second filler sequence may be located between the exon region and 3' ITR.

In one embodiment, a viral genome may comprise two filler sequences, the first filler sequence may be located between the polyadenylation signal sequence region and exon region, and the second filler sequence may be located between the MCS region and exon region. In one embodiment, a viral genome may comprise two filler sequences, the first filler sequence may be located between the polyadenylation signal sequence region and exon region, and the second filler sequence may be located between the MCS region and 3' ITR. In one embodiment, a viral genome may comprise two filler sequences, the first filler sequence may be located between the polyadenylation signal sequence region and exon region, and the second filler sequence may be located between the exon region and 3' ITR.

In one embodiment, a viral genome may comprise two filler sequences, the first filler sequence may be located between the polyadenylation signal sequence region and 3' ITR, and the second filler sequence may be located between the MCS region and exon region. In one embodiment, a viral genome may comprise two filler sequences, the first filler sequence may be located between the polyadenylation signal sequence region and 3' ITR, and the second filler sequence may be located between the MCS region and 3' ITR. In one embodiment, a viral genome may comprise two filler sequences, the first filler sequence may be located between the polyadenylation signal sequence region and 3' ITR, and the second filler sequence may be located between the exon region and 3' ITR.

In one embodiment, a viral genome may comprise two filler sequences, the first filler sequence may be located between the MCS region and exon region, and the second filler sequence may be located between the exon region and 3' ITR.

Payloads of the Invention

The AAV particles of the present disclosure comprise at least one payload region. As used herein, "payload" or "payload region" refers to one or more polynucleotides or polynucleotide regions encoded by or within a viral genome or an expression product of such polynucleotide or polynucleotide region, e.g., a transgene, a polynucleotide encoding a polypeptide or multi-polypeptide or a modulatory nucleic acid or regulatory nucleic acid. Payloads of the present invention typically encode modulatory polynucleotides or fragments or variants thereof.

The payload region may be constructed in such a way as to reflect a region similar to or mirroring the natural organization of an mRNA.

The payload region may comprise a combination of coding and non-coding nucleic acid sequences.

In some embodiments, the AAV payload region may encode a coding or non-coding RNA.

In one embodiment, the AAV particle comprises a viral genome with a payload region comprising nucleic acid sequences encoding a siRNA, miRNA or other RNAi agent. In such an embodiment, a viral genome encoding more than one polypeptide may be replicated and packaged into a viral particle. A target cell transduced with a viral particle may express the encoded siRNA, miRNA or other RNAi agent inside a single cell.

Modulatory Polynucleotides

In one embodiment, modulatory polynucleotides, e.g., RNA or DNA molecules, may be used to treat neurodegenerative disease, in particular, Huntington's Disease (HD). As used herein, a "modulatory polynucleotide" is any nucleic acid sequence(s) which functions to modulate (either increase or decrease) the level or amount of a target gene, e.g., mRNA or protein levels.

In one embodiment, the modulatory polynucleotides may comprise at least one nucleic acid sequence encoding at least one siRNA molecule. The nucleic acids may, independently if there is more than one, encode 1, 2, 3, 4, 5, 6, 7, 8, 9, or more than 9 siRNA molecules.

In one embodiment, the molecular scaffold may be located downstream of a CMV promoter, fragment or variant thereof.

In one embodiment, the molecular scaffold may be located downstream of a CBA promoter, fragment or variant thereof.

In one embodiment, the molecular scaffold may be a natural pri-miRNA scaffold located downstream of a CMV promoter. As a non-limiting example, the natural pri-miRNA scaffold is derived from the human miR155 scaffold.

In one embodiment, the molecular scaffold may be a natural pri-miRNA scaffold located downstream of a CBA promoter.

In one embodiment, the selection of a molecular scaffold and modulatory polynucleotide is determined by a method of comparing modulatory polynucleotides in pri-miRNA (see e.g., the method described by Miniarikova et al. *Design, Characterization, and Lead Selection of Therapeutic miRN4s Targeting Huntingtin for Development of Gene Therapy for Huntington's Disease*. Molecular Therapy-Nucleic Acids (2016) 5, e297 and International Publication No. WO2016102664, the contents of each of which are herein incorporated by reference in their entireties). The modulatory polynucleotide may, but it not limited to, targeting exon 1, CAG repeats, SNP rs362331 in exon 50 and/or SNP rs362307 in exon 67. To evaluate the activities of the modulatory polynucleotides, the molecular scaffold used which may be used is a human pri-miRNA scaffold (e.g., miR1155 scaffold) and the promoter may be CMV. The activity may be determined in vitro using HEK293T cells and a reporter (e.g., Luciferase). For exon 1 targeting, the modulatory polynucleotide is determined to be efficient at HTT knockdown if the knockdown is 80% or greater. For CAG targeting, the modulatory polynucleotide is determined to be efficient at HTT knockdown if the knockdown is at least 60%. For SNP targeting, the modulatory polynucleotide is determined to be efficient at HTT knockdown if the knockdown is at least 60%. For allele selectivity for CAG repeats or SNP targeting the modulatory polynucleotides may comprise at least 1 substitution in order to improve allele selectivity. As a non-limiting example, substitution may be a G or C replaced with a T or corresponding U and A or T/U replaced by a C.

In order to evaluate the optimal molecular scaffold for the modulatory polynucleotide, the modulatory polynucleotide is used in pri-miRNA scaffolds with a CAG promoter. The constructs are co-transfected with a reporter (e.g., luciferase reporter) at 50 ng. Constructs with greater than 80% knockdown at 50 ng co-transfection are considered efficient. In one aspect, the constructs with strong guide-strand activity are preferred. The molecular scaffolds can be processed in HEK293T cells by NGS to determine guide-passenger ratios, and processing variability.

To evaluate the molecular scaffolds and modulatory polynucleotides in vivo the molecular scaffolds comprising the modulatory polynucleotides are packaged in AAV (e.g., the serotype may be AAV5 (see e.g., the method and constructs described in WO2015060722, the contents of which are herein incorporated by reference in their entirety)) and administered to an in vivo model (e.g., Hu128/21 HD mouse) and the guide-passenger ratios, 5' and 3' end processing, reversal of guide and passenger strands, and knockdown can be determined in different areas of the model.

In one embodiment, the selection of a molecular scaffold and modulatory polynucleotide is determined by a method of comparing modulatory polynucleotides in natural pri-miRNA and synthetic pri-miRNA. The modulatory polynucleotide may, but it not limited to, targeting an exon other than exon 1. To evaluate the activities of the modulatory polynucleotides, the molecular scaffold is used with a CBA promoter. In one aspect, the activity may be determined in vitro using HEK293T cells, HeLa cell and a reporter (e.g., Luciferase) and knockdown efficient modulatory polynucleotides showed HTT knockdown of at least 80% in the cell tested. Additionally, the modulatory polynucleotides which are considered most efficient showed low to no significant passenger strand (p-strand) activity. In another aspect, the endogenous HTT knockdown efficacy is evaluated by transfection in vitro using HEK293T cells, HeLa cell and a reporter. Efficient modulatory polynucleotides show greater than 50% endogenous HTT knockdown. In yet another aspect, the endogenous HTT knockdown efficacy is evaluated in different cell types (e.g., HEK293, HeLa, primary astrocytes. U251 astrocytes, SH-SY5Y neuron cells and fibroblasts from HD patients) by infection (e.g., AAV2). Efficient modulatory polynucleotides show greater than 60% endogenous HTT knockdown.

To evaluate the molecular scaffolds and modulatory polynucleotides in vivo the molecular scaffolds comprising the modulatory polynucleotides are packaged in AAV and administered to an in vivo model (e.g., YAC128 HD mouse) and the guide-passenger ratios, 5' and 3' end processing, ratio of guide to passenger strands, and knockdown can be determined in different areas of the model (e.g., tissue regions). The molecular scaffolds can be processed from in vivo samples by NGS to determine guide-passenger ratios, and processing variability.

In one embodiment, the modulatory polynucleotide is designed using at least one of the following properties: loop variant, seed mismatch/bulge/wobble variant, stem mismatch, loop variant and vassal stem mismatch variant, seed mismatch and basal stem mismatch variant, stem mismatch and basal stem mismatch variant, seed wobble and basal stem wobble variant, or a stem sequence variant.

siRNA Molecules

The present invention relates to RNA interference (RNAi) induced inhibition of gene expression for treating neurodegenerative disorders. Provided herein are siRNA duplexes or encoded dsRNA that target the HTT gene (referred to herein collectively as "siRNA molecules"). Such siRNA duplexes or encoded dsRNA can reduce or silence HTT gene expression in cells, for example, medium spiny neurons, cortical neurons and/or astrocytes, thereby, ameliorating symptoms of Huntington's Disease (HD).

RNAi (also known as post-transcriptional gene silencing (PTGS), quelling, or co-suppression) is a post-transcriptional gene silencing process in which RNA molecules, in a sequence specific manner, inhibit gene expression, typically by causing the destruction of specific mRNA molecules. The active components of RNAi are short/small double stranded RNAs (dsRNAs), called small interfering RNAs (siRNAs), that typically contain 15-30 nucleotides (e.g., 19 to 25, 19 to 24 or 19-21 nucleotides) and 2 nucleotide 3' overhangs and that match the nucleic acid sequence of the target gene.

These short RNA species may be naturally produced in vivo by Dicer-mediated cleavage of larger dsRNAs and they are functional in mammalian cells.

Naturally expressed small RNA molecules, named microRNAs (miRNAs), elicit gene silencing by regulating the expression of mRNAs. The miRNAs containing RNA Induced Silencing Complex (RISC) targets mRNAs presenting a perfect sequence complementarity with nucleotides 2-7 in the 5' region of the miRNA which is called the seed region, and other base pairs with its 3' region, miRNA mediated down regulation of gene expression may be caused by cleavage of the target mRNAs, translational inhibition of the target mRNAs, or mRNA decay. miRNA targeting sequences are usually located in the 3'-UTR of the target mRNAs. A single miRNA may target more than 100 transcripts from various genes, and one mRNA may be targeted by different miRNAs.

siRNA duplexes or dsRNA targeting a specific mRNA may be designed and synthesized in vitro and introduced into cells for activating RNAi processes. Elbashir et al. demonstrated that 21-nucleotide siRNA duplexes (termed small interfering RNAs) were capable of effecting potent and specific gene knockdown without inducing immune response in mammalian cells (Elbashir S M et al., Nature, 2001, 411, 494-498). Since this initial report, post-transcriptional gene silencing by siRNAs quickly emerged as a powerful tool for genetic analysis in mammalian cells and has the potential to produce novel therapeutics.

RNAi molecules which were designed to target against a nucleic acid sequence that encodes poly-glutamine repeat proteins which cause poly-glutamine expansion diseases such as Huntington's Disease, are described in U.S. Pat. Nos. 9,169,483 and 9,181,544 and International Patent Publication No. WO2015179525, the content of each of which is herein incorporated by reference in their entirety. U.S. Pat. Nos. 9,169,483 and 9,181,544 and International Patent Publication No. WO2015179525 each provide isolated RNA duplexes comprising a first strand of RNA (e.g., 15 contiguous nucleotides) and second strand of RNA (e.g., complementary to at least 12 contiguous nucleotides of the first strand) where the RNA duplex is about 15 to 30 base pairs in length. The first strand of RNA and second strand of RNA may be operably linked by an RNA loop (~4 to 50 nucleotides) to form a hairpin structure which may be inserted into an expression cassette. Non-limiting examples of loop portions include SEQ ID NO: 9-14 of U.S. Pat. No. 9,169,483, the content of which is herein incorporated by reference in its entirety. Non-limiting examples of strands of RNA which may be used, either full sequence or part of the sequence, to form RNA duplexes include SEQ ID NO: 1-8 of U.S. Pat. No. 9,169,483 and SEQ ID NO: 1-11, 33-59, 208-210, 213-215 and 218-221 of U.S. Pat. No. 9,181,544, the contents of each of which is herein incorporated by reference in its entirety. Non-limiting examples of RNAi molecules include SEQ ID NOs: 1-8 of U.S. Pat. No. 9,169,483, SEQ ID NOs: 1-11, 33-59, 208-210, 213-215 and 218-221 of U.S. Pat. No. 9,181,544 and SEQ ID NOs: 1, 6, 7, and 35-38 of International Patent Publication No. WO2015179525, the contents of each of which is herein incorporated by reference in their entirety.

In vitro synthesized siRNA molecules may be introduced into cells in order to activate RNAi. An exogenous siRNA duplex, when it is introduced into cells, similar to the endogenous dsRNAs, can be assembled to form the RNA Induced Silencing Complex (RISC), a multiunit complex that interacts with RNA sequences that are complementary to one of the two strands of the siRNA duplex (i.e., the antisense strand). During the process, the sense strand (or passenger strand) of the siRNA is lost from the complex, while the antisense strand (or guide strand) of the siRNA is matched with its complementary RNA. In particular, the targets of siRNA containing RISC complexes are mRNAs presenting a perfect sequence complementarity. Then, siRNA mediated gene silencing occurs by cleaving, releasing and degrading the target.

The siRNA duplex comprised of a sense strand homologous to the target mRNA and an antisense strand that is complementary to the target mRNA offers much more advantage in terms of efficiency for target RNA destruction compared to the use of the single strand (ss)-siRNAs (e.g. antisense strand RNA or antisense oligonucleotides). In many cases, it requires higher concentration of the ss-siRNA to achieve the effective gene silencing potency of the corresponding duplex.

Any of the foregoing molecules may be encoded by a viral genome.

Design and Sequences of siRNA Duplexes Targeting HTT Gene

The present invention provides small interfering RNA (siRNA) duplexes (and modulatory polynucleotides encoding them) that target HTT mRNA to interfere with HTT gene expression and/or HTT protein production.

The encoded siRNA duplex of the present invention contains an antisense strand and a sense strand hybridized together forming a duplex structure, wherein the antisense strand is complementary to the nucleic acid sequence of the targeted HTT gene, and wherein the sense strand is homologous to the nucleic acid sequence of the targeted HTT gene. In some aspects, the 5' end of the antisense strand has a 5' phosphate group and the 3' end of the sense strand contains a 3'hydroxyl group. In other aspects, there are none, one or 2 nucleotide overhangs at the 3'end of each strand.

Some guidelines for designing siRNAs have been proposed in the art. These guidelines generally recommend generating a 19-nucleotide duplexed region, symmetric 2-3 nucleotide 3'overhangs, 5'-phosphate and 3'-hydroxyl groups targeting a region in the gene to be silenced. Other rules that may govern siRNA sequence preference include, but are not limited to, (i) A/U at the 5' end of the antisense strand; (ii) G/C at the 5' end of the sense strand; (iii) at least five A/U residues in the 5' terminal one-third of the antisense strand; and (iv) the absence of any GC stretch of more than 9 nucleotides in length. In accordance with such consideration, together with the specific sequence of a target gene, highly effective siRNA molecules essential for suppressing mammalian target gene expression may be readily designed.

According to the present invention, siRNA molecules (e.g., siRNA duplexes or encoded dsRNA) that target the HTT gene are designed. Such siRNA molecules can specifically, suppress HTT gene expression and protein production. In some aspects, the siRNA molecules are designed and used to selectively "knock out" HTT gene variants in cells, i.e., mutated HTT transcripts that are identified in patients with HD disease. In some aspects, the siRNA molecules are designed and used to selectively "knock down" HTT gene variants in cells. In other aspects, the siRNA molecules are able to inhibit or suppress both the wild type and mutated HTT gene.

In one embodiment, an siRNA molecule of the present invention comprises a sense strand and a complementary antisense strand in which both strands are hybridized together to form a duplex structure. The antisense strand has sufficient complementarity to the HTT mRNA sequence to direct target-specific RNAi, i.e., the siRNA molecule has a sequence sufficient to trigger the destruction of the target mRNA by the RNAi machinery or process.

In one embodiment, an siRNA molecule of the present invention comprises a sense strand and a complementary antisense strand in which both strands are hybridized together to form a duplex structure and where the start site of the hybridization to the HTT mRNA is between nucleotide 100 and 7000 on the HTT mRNA sequence. As a non-limiting example, the start site may be between nucleotide 100-150, 150-200, 200-250, 250-300, 300-350, 350-400, 400-450, 450-500, 500-550, 550-600, 600-650, 650-700, 700-70, 750-800, 800-850, 850-900, 900-950, 950-1000, 1000-1050, 1050-1100, 1100-1150, 1150-1200, 1200-1250, 1250-1300, 1300-1350, 1350-1400, 1400-1450, 1450-1500, 1500-1550, 1550-1600, 1600-1650, 1650-1700, 1700-1750, 1750-1800, 1800-1850, 1850-1900, 1900-1950, 1950-2000, 2000-2050, 2050-2100, 2100-2150, 2150-2200, 2200-2250, 2250-2300, 2300-2350, 2350-2400, 2400-2450, 2450-2500, 2500-2550, 2550-2600, 2600-2650, 2650-2700, 2700-2750, 2750-2800, 2800-2850, 2850-2900, 2900-2950, 2950-3000, 3000-3050, 3050-3100, 3100-3150, 3150-3200, 3200-3250, 3250-3300, 3300-3350, 3350-3400, 3400-3450, 3450-3500, 3500-3550, 3550-3600, 3600-3650, 3650-3700, 3700-3750, 3750-3800, 3800-3850, 3850-3900, 3900-3950, 3950-4000, 4000-4050, 4050-4100, 4100-4150, 4150-4200, 4200-4250, 4250-4300, 4300-4350, 4350-4400, 4400-4450, 4450-4500, 4500-4550, 4550-4600, 4600-4650, 4650-4700, 4700-4750, 4750-4800, 4800-4850, 4850-4900, 4900-4950, 4950-5000, 5000-5050, 5050-5100, 5100-5150, 5150-5200, 5200-5250, 5250-5300, 5300-5350, 5350-5400, 5400-5450, 5450-5500, 5500-5550, 5550-5600, 5600-5650, 5650-5700, 5700-5750, 5750-5800, 5800-5850, 5850-5900, 5900-5950, 5950-6000, 6000-6050, 6050-6100, 6100-6150, 6150-6200, 6200-6250, 6250-6300, 6300-6350, 6350-6400, 6400-6450, 6450-6500, 6500-6550, 6550-6600, 6600-6650, 6650-6700, 6700-6750, 6750-6800, 6800-6850, 6850-6900, 6900-6950, 6950-7000, 7000-7050, 7050-7100, 7100-7150, 7150-7200, 7200-7250, 7250-7300, 7300-7350, 7350-7400, 7400-7450, 7450-7500, 7500-7550, 7550-7600, 7600-7650, 7650-7700, 7700-7750, 7750-7800, 7800-7850, 7850-7900, 7900-7950, 7950-8000, 8000-8050, 8050-8100, 8100-8150, 8150-8200, 8200-8250, 8250-8300, 8300-8350, 8350-8400, 8400-8450, 8450-8500, 8500-8550, 8550-8600, 8600-8650, 8650-8700, 8700-8750, 8750-8800, 8800-8850, 8850-8900, 8900-8950, 8950-9000, 9000-9050, 9050-9100, 9100-9150, 9150-9200, 9200-9250, 9250-9300, 9300-9350, 9350-9400, 9400-9450, 9450-9500, 9500-9550, 9550-9600, 9600-9650, 9650-9700, 9700-9750, 9750-9800, 9800-9850, 9850-9900, 9900-9950, 9950-10000, 10000-10050, 10050-10100, 10100-10150, 10150-10200, 10200-10250, 10250-10300, 10300-10350, 10350-10400, 10400-10450, 10450-10500, 10500-10550, 10550-10600, 10600-10650, 10650-10700, 10700-10750, 10750-10800, 10800-10850, 10850-10900, 10900-10950, 10950-11000, 11050-11100, 11100-11150, 11150-11200, 11200-11250, 11250-11300, 11300-11350, 11350-11400, 11400-11450, 11450-11500, 11500-11550, 11550-11600, 11600-11650, 11650-11700, 11700-11750, 11750-11800, 11800-11850, 11850-11900, 11900-11950, 11950-12000, 12000-12050, 12050-12100, 12100-12150, 12150-12200, 12200-12250, 12250-12300, 12300-12350, 12350-12400, 12400-12450, 12450-12500, 12500-12550, 12550-12600, 12600-12650, 12650-12700, 12700-12750, 12750-12800, 12800-12850, 12850-12900, 12900-12950, 12950-13000, 13000-13050, 13050-13100, 13100-13150, 13150-13200, 13200-13250, 13250-13300, 13300-13350, 13350-13400, 13400-13450, and 13450-13500 on the HTT mRNA sequence. As yet another non-limiting example, the start site may be nucleotide 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 715, 716, 717, 718, 719, 720, 721, 722, 723, 724, 725, 875, 876, 877, 878, 879, 880, 881, 882, 883, 884, 885, 886, 887, 888, 889, 890, 891, 892, 893, 894, 895, 896, 897, 898, 899, 900, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1660, 1661, 1662, 1663, 1664, 1665, 1666, 1667, 1668, 1669, 1670, 1671, 1672, 1673, 1674, 1675, 2050, 2051, 2052, 2053, 2054, 2055, 2056, 2057, 2058, 2059, 2060, 2061, 2062, 2063, 2064, 2065, 2066, 2067, 2068, 2069, 2070, 2071, 2072, 2073, 2074, 2075, 2076, 2077, 2078, 2079, 2080, 2081, 2082, 2083, 2084, 2085, 2086, 2087, 2088, 2089, 2090, 2091, 2092, 2093, 2094, 2095, 2096, 2097, 2098, 2099, 2100, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, 2605, 4525, 4526, 4527, 4528, 4529, 4530, 4531, 4532, 4533, 4534, 4535, 4536, 4537, 4538, 4539, 4540, 4541, 4542, 4543, 4544, 4545, 4546, 4547, 4548, 4549, 4550, 4575, 4576, 4577, 4578, 4579, 4580, 4581, 4582, 4583, 4584, 4585, 4586, 4587, 4588, 4589, 4590, 4591, 4592, 4593, 4594, 4595, 4596, 4597, 4598, 4599, 4600, 4850, 4851, 4852, 4853, 4854, 4855, 4856, 4857, 4858, 4859, 4860, 4861, 4862, 4863, 4864, 4865, 4866, 4867, 4868, 4869, 4870, 4871, 4872, 4873, 4874, 4875, 4876, 4877, 4878, 4879, 4880, 4881, 4882, 4883, 4884, 4885, 4886, 4887, 4888, 4889, 4890, 4891, 4892, 4893, 4894, 4895, 4896, 4897, 4898, 4899, 4900, 5460, 5461, 5462, 5463, 5464, 5465, 5466, 5467, 5468, 5469, 5470, 5471, 5472, 5473, 5474, 5475, 5476, 5477, 5478, 5479, 5480, 6175, 6176, 6177, 6178, 6179, 6180, 6181, 6182, 6183, 6184, 6185, 6186, 6187, 6188, 6189, 6190, 6191, 6192, 6193, 6194, 6195, 6196, 6197, 6198, 6199, 6200, 6315, 6316, 6317, 6318, 6319, 6320, 6321, 6322, 6323, 6324, 6325, 6326, 6327, 6328, 6329, 6330, 6331, 6332, 6333, 6334, 6335, 6336, 6337, 6338, 6339, 6340, 6341, 6342, 6343, 6344, 6345, 6600, 6601, 6602, 6603, 6604, 6605, 6606, 6607, 6608, 6609, 6610, 6611, 6612, 6613, 6614, 6615, 6725, 6726, 6727, 6728, 6729, 6730, 6731, 6732, 6733, 6734, 6735, 6736, 6737, 6738, 6739, 6740, 6741, 6742, 6743, 6744, 6745, 6746, 6747, 6748, 6749, 6750, 6751, 6752, 6753, 6754, 6755, 6756, 6757, 6758, 6759, 6760, 6761, 6762, 6763, 6764, 6765, 6766, 6767, 6768, 6769, 6770, 6771, 6772, 6773, 6774, 6775, 7655, 7656, 7657, 7658, 7659, 7660, 7661, 7662, 7663, 7664, 7665, 7666, 7667, 7668, 7669, 7670, 7671, 7672, 8510, 8511, 8512, 8513, 8514, 8515, 8516, 8715, 8716, 8717, 8718, 8719, 8720, 8721, 8722, 8723, 8724, 8725, 8726, 8727, 8728, 8729, 8730, 8731, 8732, 8733, 8734, 8735, 8736, 8737, 8738, 8739, 8740, 8741, 8742, 8743, 8744, 8745, 9250, 9251, 9252, 9253, 9254, 9255, 9256, 9257, 9258, 9259, 9260, 9261, 9262, 9263, 9264, 9265, 9266, 9267, 9268, 9269, 9270, 9480, 9481, 9482, 9483, 9484, 9485, 9486, 9487, 9488, 9489, 9490, 9491, 9492, 9493, 9494, 9495, 9496, 9497, 9498, 9499, 9500, 9575, 9576, 9577, 9578, 9579, 9580, 9581, 9582, 9583, 9584, 9585, 9586, 9587, 9588, 9589, 9590, 10525, 10526, 10527, 10528, 10529, 10530, 10531, 10532, 10533, 10534, 10535, 10536, 10537, 10538, 10539, 10540, 11545, 11546, 11547, 11548, 11549, 11550, 11551, 11552, 11553, 11554, 11555, 11556, 11557, 11558, 11559, 11560, 11875, 11876, 11877, 11878, 11879, 11880, 11881, 11882, 11883, 11884, 11885, 11886, 11887, 11888, 11889, 11890, 11891, 11892, 11893, 11894, 11895, 11896, 11897, 11898, 11899, 11900, 11915, 11916, 11917, 11918, 11919, 11920, 11921, 11922, 11923, 11924, 11925, 11926, 11927, 11928, 11929, 11930, 11931, 11932, 11933, 11934, 11935, 11936, 11937, 11938, 11939, 11940, 13375, 13376, 13377, 13378, 13379, 13380, 13381, 13382, 13383, 13384, 13385, 13386, 13387, 13388, 13389 and 13390 on the HTT mRNA sequence.

In some embodiments, the antisense strand and target mRNA sequences have 100% complementarity. The antisense strand may be complementary to any part of the target mRNA sequence.

In other embodiments, the antisense strand and target mRNA sequences comprise at least one mismatch. As a non-limiting example, the antisense strand and the target mRNA sequence have at least 30%, 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98% or 99% or at least 20-30%, 20-40%, 20-50%, 20-60%, 20-70%, 20-80%, 20-90%, 20-95%, 20-99%, 30-40%, 30-50%, 30-60%, 30-70%, 30-80%, 30-90%, 30-95%, 30-99%, 40-50%, 40-60%, 40-70%, 40-80%, 40-90%, 40-95%, 40-99%, 50-60%, 50-70%, 50-80%, 50-90%, 50-95%, 50-99%, 60-70%, 60-80%, 60-90%, 60-95%, 60-99%, 70-80%, 70-90%, 70-95%, 70-99%, 80-90%, 80-95%, 80-99%, 90-95%, 90-99% or 95-99% complementarity.

In one embodiment, an siRNA or dsRNA includes at least two sequences that are complementary to each other.

According to the present invention, the siRNA molecule has a length from about 10-50 or more nucleotides, i.e., each strand comprising 10-50 nucleotides (or nucleotide analogs). Preferably, the siRNA molecule has a length from about 15-30. e.g., 15, 16, 17, 18, 19, 20, 21, 22, 23, 24, 25, 26, 27, 28, 29, or 30 nucleotides in each strand, wherein one of the strands is sufficiently complementarity to a target region. In one embodiment, each strand of the siRNA molecule has a length from about 19 to 25, 19 to 24 or 19 to 21 nucleotides. In one embodiment, at least one strand of the siRNA molecule is 19 nucleotides in length. In one embodiment, at least one strand of the siRNA molecule is 20 nucleotides in length. In one embodiment, at least one strand of the siRNA molecule is 21 nucleotides in length. In one embodiment, at least one strand of the siRNA molecule is 22 nucleotides in length. In one embodiment, at least one strand of the siRNA molecule is 23 nucleotides in length. In one embodiment, at least one strand of the siRNA molecule is 24 nucleotides in length. In one embodiment, at least one strand of the siRNA molecule is 25 nucleotides in length.

In some embodiments, the siRNA molecules of the present invention can be synthetic RNA duplexes comprising about 19 nucleotides to about 25 nucleotides, and two overhanging nucleotides at the 3'-end. In some aspects, the siRNA molecules may be unmodified RNA molecules. In other aspects, the siRNA molecules may contain at least one modified nucleotide, such as base, sugar or backbone modifications.

In one embodiment, the siRNA molecules of the present invention may comprise a nucleotide sequence such as, but not limited to, the antisense (guide) sequences in Table 2 or a fragment or variant thereof. As a non-limiting example, the antisense sequence used in the siRNA molecule of the present invention is at least 30%, 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98% or 99% or at least 20-30%, 20-40%, 20-50%, 20-60%, 20-70%, 20-80%, 20-90%, 20-95%, 20-99%, 30-40%, 30-50%, 30-60%, 30-70%, 30-80%, 30-90%, 30-95%, 30-99%, 40-50%, 40-60%, 40-70%, 40-80%, 40-90%, 40-95%, 40-99%, 50-60%, 50-70%, 50-80%, 50-90%, 50-95%, 50-99%, 60-70%, 60-80%, 60-90%, 60-95%, 60-99%, 70-80%, 70-90%, 70-95%, 70-99%, 80-90%, 80-95%, 80-99%, 90-95%, 90-99% or 95-99% of a nucleotide sequence in Table 2. As another non-limiting example, the antisense sequence used in the siRNA molecule of the present invention comprises at least 3, 4, 5, 6, 7, 8, 9, 10, 11, 12, 13, 14, 15, 16, 17, 18, 19, 20, 21 or more than 21 consecutive nucleotides of a nucleotide sequence in Table 2. As yet another non-limiting example, the antisense sequence used in the siRNA molecule of the present invention comprises nucleotides 1 to 22, 1 to 21, 1 to 20, 1 to 19, 1 to 18, 1 to 17, 1 to 16, 1 to 15, 1 to 14, 1 to 13, 1 to 12, 1 to 11, 1 to 10, 1 to 9, 1 to 8, 2 to 22, 2 to 21, 2 to 20, 2 to 19, 2 to 18, 2 to 17, 2 to 16, 2 to 15, 2 to 14, 2 to 13, 2 to 12, 2 to 11, 2 to 10, 2 to 9, 2 to 8, 3 to 22, 3 to 21, 3 to 20, 3 to 19, 3 to 18, 3 to 17, 3 to 16, 3 to 15, 3 to 14, 3 to 13, 3 to 12, 3 to 11, 3 to 10, 3 to 9, 3 to 8, 4 to 22, 4 to 21, 4 to 20, 4 to 19, 4 to 18, 4 to 17, 4 to 16, 4 to 15, 4 to 14, 4 to 13, 4 to 12, 4 to 11, 4 to 10, 4 to 9, 4 to 8, 5 to 22, 5 to 21, 5 to 20, 5 to 19, 5 to 18, 5 to 17, 5 to 16, 5 to 15, 5 to 14, 5 to 13, 5 to 12, 5 to 11, 5 to 10, 5 to 9, 5 to 8, 6 to 22, 6 to 21, 6 to 20, 6 to 19, 6 to 18, 6 to 17, 6 to 16, 6 to 15, 6 to 14, 6 to 13, 6 to 12, 6 to 11, 6 to 10, 7 to 22, 7 to 21, 7 to 20, 7 to 19, 7 to 18, 7 to 17, 7 to 16, 7 to 15, 7 to 14, 7 to 13, 7 to 12, 8 to 22, 8 to 21, 8 to 20, 8 to 19, 8 to 18, 8 to 17, 8 to 16, 8 to 15, 8 to 14, 8 to 13, 8 to 12, 9 to 22, 9 to 21, 9 to 20, 9 to 19, 9 to 18, 9 to 17, 9 to 16, 9 to 15, 9 to 14, 10 to 22, 10 to 21, 10 to 20, 10 to 19, 10 to 18, 10 to 17, 10 to 16, 10 to 15, 10 to 14, 11 to 22, 11 to 21, 11 to 20, 11 to 19, 11 to 18, 11 to 17, 11 to 16, 11 to 15, 11 to 14, 12 to 22, 12 to 21, 12 to 20, 12 to 19, 12 to 18, 12 to 17, 12 to 16, 13 to 22, 13 to 21, 13 to 20, 13 to 19, 13 to 18, 13 to 17, 13 to 16, 14 to 22, 14 to 21, 14 to 20, 14 to 19, 14 to 18, 14 to 17, 15 to 22, 15 to 21, 15 to 20, 15 to 19, 15 to 18, 16 to 22, 16 to 21, 16 to 20, 17 to 22, 17 to 21, or 18 to 22 of the sequences in Table 2.

TABLE 2

Antisense Sequences

| Antisense ID | Sequence | SEQ ID NO |
|---|---|---|
| A-2000 | UUAACGUCAGUUCAUAAACUU | 914 |
| A-2000dt | UUAACGUCAGUUCAUAAACdTdT | 915 |
| A-2001 | UGUCGGUACCGUCUAACACUU | 916 |
| A-2001dt | UGUCGGUACCGUCUAACACdTdT | 917 |
| A-2002 | UAAGCAUGGAGCUAGCAGGUU | 918 |
| A-2002dt | UAAGCAUGGAGCUAGCAGGdTdT | 919 |
| A-2003 | UACAACGAGACUGAAUUGCUU | 920 |
| A-2003dt | UACAACGAGACUGAAUUGCdTdT | 921 |
| A-2004 | UUCAGUUCAUAAACCUGGAUU | 922 |

TABLE 2-continued

Antisense Sequences

| Antisense ID | Sequence | SEQ ID NO |
|---|---|---|
| A-2004dt | UUCAGUUCAUAAACCUGGAdTdT | 923 |
| A-2005 | UAACGUCAGUUCAUAAACCUU | 924 |
| A-2005dt | UAACGUCAGUUCAUAAACCdTdT | 925 |
| A-2006 | UCCGGUCACAACAUUGUGGUU | 926 |
| A-2006dt | UCCGGUCACAACAUUGUGGdTdT | 927 |
| A-2007 | UUGCACGGUUCUUUGUGACUU | 928 |
| A-2007dt | UUGCACGGUUCUUUGUGACdTdT | 929 |
| A-2008 | UUUUAUAACAAGAGGUUCAUU | 930 |
| A-2008dt | UUUUAUAACAAGAGGUUCAdTdT | 931 |
| A-2009 | UCCAAAUACUGGUUGUCGGUU | 932 |
| A-2009dt | UCCAAAUACUGGUUGUCGGdTdT | 933 |
| A-2010 | UAUUUAGGAAUUCCAAUGUU | 934 |
| A-2010dt | UAUUUAGGAAUUCCAAUGdTdT | 935 |
| A-2011 | UUUAGGAAUUCCAAUGAUCUU | 936 |
| A-2011dt | UUUAGGAAUUCCAAUGAUCdTdT | 937 |
| A-2012dt | UUAAUCUCUUUACUGAUAUdTdT | 938 |
| A-2013dt | GAUUUUAGGAAUUCCAAUGdTdT | 939 |
| A-2014 | UAAGCAUGGAGCUAGCAGGCUU | 940 |
| A-2015 | UAAGCAUGGAGCUAGCAGGU | 941 |
| A-2016 | AAGGACUUGAGGGACUCGAAGU | 942 |
| A-2017 | AAGGACUUGAGGGACUCGAAG | 943 |
| A-2018 | AAGGACUUGAGGGACUCGA | 944 |
| A-2019 | AGGACUUGAGGGACUCGAAGU | 945 |
| A-2020 | GAGGACUUGAGGGACUCGAAGU | 946 |
| A-2021 | AAGGACUUGAGGGACUCGAAGU | 947 |
| A-2022 | AAGGACUUGAGGGACUCGAAGUU | 948 |
| A-2023 | AAGGACUUGAGGGACUCGAAG | 949 |
| A-2024 | AAGGACUUGAGGGACUCGA | 950 |
| A-2025 | AAGGACUUGAGGGACUCGAAGG | 951 |
| A-2026 | AAGGACUUGAGGGACUCGAAU | 952 |
| A-2027 | AAGGACUUGAGGGACUCGAAGA | 953 |
| A-2028 | AAGGACUUGAGGGACUCGAAGG | 954 |
| A-2029 | AAGGACUUGAGGGACUCGAAGGU | 955 |
| A-2030 | AAGGACUUGAGGGACUCGAAGGA | 956 |
| A-2031 | AAGGACUUGAGGGACUCGAAG | 957 |
| A-2032 | AAGGACUUGAGGGACUCGAAGU | 958 |
| A-2033 | AAGGACUUGAGGGACUCGA | 959 |
| A-2034 | AAGGACUUGAGGGACUCGAAGGA | 960 |
| A-2035 | AAGGACUUGAGGGACUCGAAGG | 961 |
| A-2036 | AAGGACUUGAGGGACUCGAAGGAU | 962 |
| A-2037 | AAGGACUUGAGGGACUCGAAGGAUU | 963 |
| A-2038 | AAGGACUUGAGGGACUCGAAG | 964 |
| A-2039 | AAGGACUUGAGGGACUCGAAGGAA | 965 |
| A-2040 | GAUGAAGUGCACACAUUGGAUGA | 966 |
| A-2041 | GAUGAACUGACACAUUGGAUG | 967 |
| A-2042 | GAUGAAUUGCACACAGUAGAUGA | 968 |
| A-2043 | AAGGACUUGAGGGACUCGAAGGUU | 969 |
| A-2044 | AAGGACUUGAGGGACUCGAAGGUUU | 970 |
| A-2045 | AAGGACUUGAGGGACUCGAAGGU | 971 |
| A-2046 | AAGGACUUGAGGGACUCGAAGGUUUU | 972 |
| A-2047 | AAGGACUUGAGGGACUCGAAGGUUUUU | 973 |
| A-2048 | AAGGACUUGAGGGACUCGAAGG | 974 |
| A-2049 | UAAGGACUUGAGGGACUCGAAG | 975 |
| A-2050 | AAGGACUUGAGGGACUCGAAG | 976 |
| A-2051 | AAGGACUUGAGGGACUCGAAGU | 977 |
| A-2052 | AAGGACUUGAGGGACUCGAAGACGAGUCCC | 978 |
| A-2053 | AAGGACUUGAGGGACUCGAAGACGAGUCCCA | 979 |
| A-2054 | AAGGACUUGAGGGACUCGAAGACGAGUCCCU | 980 |
| A-2055 | GAUGAAGUGCACACAUUGGAUAC | 981 |
| A-2056 | GAUGAAGUGCACACAUUGGAUACA | 982 |
| A-2057 | GAUGAAGUGCACACAUUGGAUACAAUGUGU | 983 |
| A-2058 | GAUGAAGUGCACACAUUGGAU | 984 |
| A-2059 | GAUGAAGUGCACACAUUGGAUA | 985 |
| A-2060 | GAUGAAUUGCACACAGUAGAUAU | 986 |
| A-2061 | GAUGAAUUGCACACAGUAGAUAUAC | 987 |
| A-2062 | GAUGAAUUGCACACAGUAGAUAUACUGUGU | 988 |
| A-2063 | GAUGAAUUGCACACAGUAGAUAUA | 989 |
| A-2064 | AUGAAUUGCACACAGUAGAUAUAC | 990 |
| A-2065 | GAUGAAUUGCACACAGUAGAUA | 991 |
| A-2066 | GAUGAAUUGCACACAGUAGAUAUACUGUGU | 992 |
| A-2067 | UACAACGAGACUGAAUUGCU | 993 |
| A-2068 | ACAACGAGACUGAAUUGCUU | 994 |
| A-2069 | UCCGGUCACAACAUUGUGGUUC | 995 |
| A-2070 | UCCGGUCACAACAUUGUGGU | 996 |

TABLE 2-continued

Antisense Sequences

| Antisense ID | Sequence | SEQ ID NO |
|---|---|---|
| A-2071 | UCCGGUCACAACAUUGUG | 997 |
| A-2072 | CCGGUCACAACAUUGUGGUU | 998 |
| A-2073 | UUUUAUAACAAGAGGUUCAU | 999 |
| A-2074 | UUUAUAACAAGAGGUUCAUU | 1000 |
| A-2075 | UAAGCAUGGAGCUAGCAGGU | 1001 |
| A-2076 | AAGCAUGGAGCUAGCAGGUU | 1002 |
| A-2077 | CCAAAUACUGGUUGUCGGUU | 1003 |
| A-2078 | UACAACGAGACUGAAUUGCUUU | 1004 |
| A-2079 | UAACGUCAGUUCAUAAACCUUU | 1005 |
| A-2080 | GUCCGGUCACAACAUUGUGGUU | 1006 |
| A-2081 | UCCGGUCACAACAUUGUGGUUUG | 1007 |
| A-2082 | UCCGGUCACAACAUUGUGGUUU | 1008 |
| A-2083 | UCCGGUCACAACAUUGUGG | 1009 |
| A-2084 | UAAGCAUGGAGCUAGCAGGUUU | 1010 |
| A-2085 | AAGCAUGGAGCUAGCAGGUUU | 1011 |
| A-2086 | UCCAAAUACUGGUUGUCGGUUU | 1012 |
| A-2087 | CCAAAUACUGGUUGUCGGUUU | 1013 |

In one embodiment, the siRNA molecules of the present invention may compromise a nucleotide sequence such as, but not limited to, the sense (passenger) sequences in Table 3 or a fragment or variant thereof. As a non-limiting example, the sense sequence used in the siRNA molecule of the present invention is at least 30%, 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98% or 99% or at least 20-30%, 20-40%, 20-50%, 20-60%, 20-70%, 20-80%, 20-90%, 20-95%, 20-99%, 30-40%, 30-50%, 30-60%, 30-70%, 30-80%, 30-90%, 30-95%, 30-99%, 40-50%, 40-60%, 40-70%, 40-80%, 40-90%, 40-95%, 40-99%, 50-60%, 50-70%, 50-80%, 50-90%, 50-95%, 50-99%, 60-70%, 60-80%, 60-90%, 60-95%, 60-99%, 70-80%, 70-90%, 70-95%, 70-99%, 80-90%, 80-95%, 80-99%, 90-95%, 90-99% or 95-99% of a nucleotide sequence in Table 3. As another non-limiting example, the sense sequence used in the siRNA molecule of the present invention comprises at least 3, 4, 5, 6, 7, 8, 9, 10, 11, 12, 13, 14, 15, 16, 17, 18, 19, 20, 21 or more than 21 consecutive nucleotides of a nucleotide sequence in Table 3. As yet another non-limiting example, the sense sequence used in the siRNA molecule of the present invention comprises nucleotides 1 to 22, 1 to 21, 1 to 20, 1 to 19, 1 to 18, 1 to 17, 1 to 16, 1 to 15, 1 to 14, 1 to 13, 1 to 12, 1 to 11, 1 to 10, 1 to 9, 1 to 8, 2 to 22, 2 to 21, 2 to 20, 2 to 19, 2 to 18, 2 to 17, 2 to 16, 2 to 15, 2 to 14, 2 to 13, 2 to 12, 2 to 11, 2 to 10, 2 to 9, 2 to 8, 3 to 22, 3 to 21, 3 to 20, 3 to 19, 3 to 18, 3 to 17, 3 to 16, 3 to 15, 3 to 14, 3 to 13, 3 to 12, 3 to 11, 3 to 10, 3 to 9, 3 to 8, 4 to 22, 4 to 21, 4 to 20, 4 to 19, 4 to 18, 4 to 17, 4 to 16, 4 to 15, 4 to 14, 4 to 13, 4 to 12, 4 to 11, 4 to 10, 4 to 9, 4 to 8, 5 to 22, 5 to 21, 5 to 20, 5 to 19, 5 to 18, 5 to 17, 5 to 16, 5 to 15, 5 to 14, 5 to 13, 5 to 12, 5 to 11, 5 to 10, 5 to 9, 5 to 8, 6 to 22, 6 to 21, 6 to 20, 6 to 19, 6 to 18, 6 to 17, 6 to 16, 6 to 15, 6 to 14, 6 to 13, 6 to 12, 6 to 11, 6 to 10, 7 to 22, 7 to 21, 7 to 20, 7 to 19, 7 to 18, 7 to 17, 7 to 16, 7 to 15, 7 to 14, 7 to 13, 7 to 12, 8 to 22, 8 to 21, 8 to 20, 8 to 19, 8 to 18, 8 to 17, 8 to 16, 8 to 15, 8 to 14, 8 to 13, 8 to 12, 9 to 22, 9 to 21, 9 to 20, 9 to 19, 9 to 18, 9 to 17, 9 to 16, 9 to 15, 9 to 14, 10 to 22, 10 to 21, 10 to 20, 10 to 19, 10 to 18, 10 to 17, 10 to 16, 10 to 15, 10 to 14, 11 to 22, 11 to 21, 11 to 20, 11 to 19, 11 to 18, 11 to 17, 11 to 16, 11 to 15, 11 to 14, 12 to 22, 12 to 21, 12 to 20, 12 to 19, 12 to 18, 12 to 17, 12 to 16, 13 to 22, 13 to 21, 13 to 20, 13 to 19, 13 to 18, 13 to 17, 13 to 16, 14 to 22, 14 to 21, 14 to 20, 14 to 19, 14 to 18, 14 to 17, 15 to 22, 15 to 21, 15 to 20, 15 to 19, 15 to 18, 16 to 22, 16 to 21, 16 to 20, 17 to 22, 17 to 21, or 18 to 22 of the sequences in Table 3.

TABLE 3

Sense Sequences

| Sense ID | Sequence | SEQ ID NO |
|---|---|---|
| S-1000 | GUUUAUGAACUGAUCUUACCC | 1014 |
| S-1001 | GUGUUAGACGGUACUGAUCCC | 1015 |
| S-1002 | CCUGCUAGCUCCAUGCUUCCC | 1016 |
| S-1003 | GUUUAUGAACUGAUCUUAGCC | 1017 |
| S-1004 | GUGUUAGACGGUACUGAUGCC | 1018 |
| S-1005 | CCUGCUAGCUCCAUGCUUGCC | 1019 |
| S-1006 | GUUUAUGAAGUGAUCUUAACC | 1020 |
| S-1007 | GUGUUAGACCGUACUGAUACC | 1021 |
| S-1008 | CCUGCUAGCACCAUGCUUACC | 1022 |
| S-1009 | GUUUAUGAACUGAUCUUAACC | 1023 |
| S-1010 | GUGUUAGACGGUACUGAUACC | 1024 |
| S-1011 | CCUGCUAGCUCCAUGCUUACC | 1025 |
| S-1011dt | CCUGCUAGCUCCAUGCUUAdTdT | 1026 |
| S-1012 | GUUUAUGAACUGAUCUUGCCC | 1027 |
| S-1013 | GUUUAUGAACUGAUCUUGGCC | 1028 |
| S-1014 | GUUUAUGAACUGAUCUUGACC | 1029 |
| S-1015 | GCAAUUCAGUCUCGUUGUCCC | 1030 |
| S-1016 | UCCAGGUUUAUGAACUGACCC | 1031 |
| S-1017 | GGUUUAUGAACUGACGUUCCC | 1032 |
| S-1018 | CCACAAUGUUGUGACUGGCCC | 1033 |
| S-1019 | GUCACAAAGAACCGUGUACCC | 1034 |
| S-1020 | UGAACCUCUUGUUAUAAACCC | 1035 |
| S-1021 | CCGACAACCAGUAUUUGGCCC | 1036 |
| S-1022 | GCAAUUCAGUCUCGUUGUGCC | 1037 |
| S-1023 | UCCAGGUUUAUGAACUGAGCC | 1038 |
| S-1024 | GGUUUAUGAACUGACGUUGCC | 1039 |

TABLE 3-continued

Sense Sequences

| Sense ID | Sequence | SEQ ID NO |
|---|---|---|
| S-1025 | CCACAAUGUUGUGACUGGGCC | 1040 |
| S-1026 | GUCACAAAGAACCGUGUAGCC | 1041 |
| S-1027 | UGAACCUCUUGUUAUAAAGCC | 1042 |
| S-1028 | CCGACAACCAGUAUUUGGGCC | 1043 |
| S-1029 | GCAAUUCAGUCUCGUUGUACC | 1044 |
| S-1029dt | GCAAUUCAGUCUCGUUGUAdTdT | 1045 |
| S-1030 | UCCAGGUUUAUGAACUGAACC | 1046 |
| S-1030dt | UCCAGGUUUAUGAACUGAAdTdT | 1047 |
| S-1031 | GGUUUAUGAACUGACGUUACC | 1048 |
| S-1032 | CCACAAUGUUGUGACUGGACC | 1049 |
| S-1033 | GUCACAAAGAACCGUGUAACC | 1050 |
| S-1034 | UGAACCUCUUGUUAUAAAACC | 1051 |
| S-1034dt | UGAACCUCUUGUUAUAAAAdTdT | 1052 |
| S-1035 | CCGACAACCAGUAUUUGGACC | 1053 |
| S-1035dt | CCGACAACCAGUAUUUGGAdTdT | 1054 |
| S-1036 | GCAAUUCAGACUCGUUGUACC | 1055 |
| S-1037 | UCCAGGUUUUUGAACUGAACC | 1056 |
| S-1038 | GGUUUAUGAUCUGACGUUACC | 1057 |
| S-1039 | CCACAAUGUAGUGACUGGACC | 1058 |
| S-1040 | GUCACAAAGUACCGUGUAACC | 1059 |
| S-1041 | UGAACCUCUAGUUAUAAAACC | 1060 |
| S-1042 | CCGACAACCUGUAUUUGGACC | 1061 |
| S-1043 | CAUUGGAAUUCCUAAAAUUCC | 1062 |
| S-1044 | GAUCAUUGGAAUUCCUAAUCC | 1063 |
| S-1045 | CAUUGGAAUUCCUAAAAUGCC | 1064 |
| S-1046 | GAUCAUUGGAAUUCCUAAGCC | 1065 |
| S-1047 | CAUUGGAAUUCCUAAAAUACC | 1066 |
| S-1047dt | CAUUGGAAUUCCUAAAAUAdTdT | 1067 |
| S-1048 | GAUCAUUGGAAUUCCUAAACC | 1068 |
| S-1048dt | GAUCAUUGGAAUUCCUAAAdTdT | 1069 |
| S-1049 | CAUUGGAAUACCUAAAAUACC | 1070 |
| S-1050 | GAUCAUUGGUAUUCCUAAACC | 1071 |
| S-1051dt | GUUUAUGAACUGACGUUAAdTdT | 1072 |
| S-1052dt | GUGUUAGACGGUACCGACAdTdT | 1073 |
| S-1053dt | AUAUCAGUAAAGAGAUUAAdTdT | 1074 |
| S-1054dt | GGUUUAUGAACUGACGUUAdTdT | 1075 |
| S-1055dt | CCACAAUGUUGUGACCGGAdTdT | 1076 |
| S-1056dt | GUCACAAAGAACCGUGCAAdTdT | 1077 |
| S-1057dt | CAUUGGAAUUCCUAAAAUCdTdT | 1078 |
| S-1058 | CCUGCUAGCUCCAUGCUUGCU | 1079 |
| S-1059 | CCUGCUAGCUCCAUGCUUGAU | 1080 |
| S-1060 | CCUGCUAGCUCCAUGCUUAUU | 1081 |
| S-1061 | CCUGCUAGCUCCAUGCUUGUU | 1082 |
| S-1062 | UUCGAGUCCCUCAAGUAGCU | 1083 |
| S-1063 | UUCGAGUCCCUCAAGUAGCUU | 1084 |
| S-1064 | UCGAGUCCCUCAAGUCCAUUCU | 1085 |
| S-1065 | UUCCAGUCCAUCAAGUCAAUU | 1086 |
| S-1066 | UUCCGAGUCUAAAAGUCCUUGG | 1087 |
| S-1067 | UUCCGAGUCUAAAAGUCCUUGGC | 1088 |
| S-1068 | CUUCCGAGUCUAAAAGUCCUUGG | 1089 |
| S-1069 | UUCCGAGUCUAAAAGUCCUUGGU | 1090 |
| S-1070 | UUCCGAGUCUAAAAGUCCUUGGCU | 1091 |
| S-1071 | UCCAAUGUGAAACUUCAUCGGCU | 1092 |
| S-1072 | UCCAAUGUGAAACUUCAUCGGC | 1093 |
| S-1073 | AUCCAAUGUGAAACUUCAUCGU | 1094 |
| S-1074 | AUCCAAUGUGAAACUUCAUCGGU | 1095 |
| S-1075 | UCCAAUGUGAAACUUCAUCGGU | 1096 |
| S-1076 | UCCAAUGUGAAACUUCAUCGGCUU | 1097 |
| S-1077 | AUCUACUGUGAAAUUCAUCGG | 1098 |
| S-1078 | UCUACUGUGAAAAUUCAUCGG | 1099 |
| S-1079 | UCUACUGUGAAAAUUCAUCGGC | 1100 |
| S-1080 | AUCUACUGUGAAAUUCAUCGGU | 1101 |
| S-1081 | UCUACUGUGAAAAUUCAUCGGU | 1102 |
| S-1082 | UCUACUGUGAAAAUUCAUCGGCU | 1103 |
| S-1083 | CCUUCGGUCCUCAAGUCCUUCA | 1104 |
| S-1084 | UUCGAGUCCAUCAAAUCCUAUAGU | 1105 |
| S-1085 | UACAAUGUGUGCACUUAUAU | 1106 |
| S-1086 | UAUACUGUGUGCAAUUCAUUUCU | 1107 |
| S-1087 | GCAAUUCAGUCUCGUUGUCC | 1108 |
| S-1088 | GCAAUUCAGUCUCGUUGUC | 1109 |
| S-1089 | CAAUUCAGUCUCGUUGUCCC | 1110 |

TABLE 3-continued

Sense Sequences

| Sense ID | Sequence | SEQ ID NO |
|---|---|---|
| S-1090 | CAAUUCAGUCUCGUUGUCC | 1111 |
| S-1091 | GCAAUUCAGUCUCGUUGUGC | 1112 |
| S-1092 | CAAUUCAGUCUCGUUGUGCC | 1113 |
| S-1093 | CCACAAUGUUGUGACUGGGCCU | 1114 |
| S-1094 | CCACAAUGUUGUGACUGGGC | 1115 |
| S-1095 | CACAAUGUUGUGACUGGGCC | 1116 |
| S-1096 | UGAACCUCUUGUUAUAAAGCCU | 1117 |
| S-1097 | UGAACCUCUUGUUAUAAAGC | 1118 |
| S-1098 | GAACCUCUUGUUAUAAAGCC | 1119 |
| S-1099 | CCUGCUAGCUCCAUGCUUGCCU | 1120 |
| S-1100 | CCUGCUAGCUCCAUGCUUGC | 1121 |
| S-1101 | CCUGCUAGCUCCAUGCUUG | 1122 |
| S-1102 | CUGCUAGCUCCAUGCUUGCC | 1123 |
| S-1103 | CCGACAACCAGUAUUUGGGCCU | 1124 |
| S-1104 | CCGACAACCAGUAUUUGGGC | 1125 |
| S-1105 | CCGACAACCAGUAUUUGGG | 1126 |
| S-1106 | CGACAACCAGUAUUUGGGCC | 1127 |
| S-1107 | CGACAACCAGUAUUUGGGC | 1128 |
| S-1108 | GCAAUUCAGUCUCGUUGUACCU | 1129 |
| S-1109 | GCAAUUCAGUCUCGUUGUAC | 1130 |
| S-1110 | GCAAUUCAGUCUCGUUGUA | 1131 |
| S-1111 | CAAUUCAGUCUCGUUGUACC | 1132 |
| S-1112 | GCAAUUCAGACUCGUUGUACCU | 1133 |
| S-1113 | GCAAUUCAGACUCGUUGUAC | 1134 |
| S-1114 | GCAAUUCAGACUCGUUGUA | 1135 |
| S-1115 | CAAUUCAGACUCGUUGUACC | 1136 |
| S-1116 | AGCAAUUCAGUCUCGUUGUACC | 1137 |
| S-1117 | AGCAAUUCAGUCUCGUUGUAC | 1138 |
| S-1118 | AGGUUUAUGAACUGACGUUAC | 1139 |
| S-1119 | AGGUUUAUGAACUGACGUUACC | 1140 |
| S-1120 | ACCACAAUGUUGUGACUGGAC | 1141 |
| S-1121 | ACCACAAUGUUGUGACUGGACC | 1142 |
| S-1122 | CCACAAUGUUGUGACUGGACCGU | 1143 |
| S-1123 | CCACAAUGUUGUGACUGGACCG | 1144 |
| S-1124 | CCACAAUGUUGUGACUGGAC | 1145 |
| S-1125 | CACAAUGUUGUGACUGGACC | 1146 |
| S-1126 | ACCUGCUAGCUCCAUGCUUCCC | 1147 |

TABLE 3-continued

Sense Sequences

| Sense ID | Sequence | SEQ ID NO |
|---|---|---|
| S-1127 | ACCUGCUAGCUCCAUGCUUCC | 1148 |
| S-1128 | ACCUGCUAGCUCCAUGCUUC | 1149 |
| S-1129 | CCUGCUAGCUCCAUGCUUCC | 1150 |
| S-1130 | CCUGCUAGCUCCAUGCUUC | 1151 |
| S-1131 | CUGCUAGCUCCAUGCUUCCC | 1152 |
| S-1132 | CUGCUAGCUCCAUGCUUCC | 1153 |
| S-1133 | ACCGACAACCAGUAUUUGGACC | 1154 |
| S-1134 | ACCGACAACCAGUAUUUGGAC | 1155 |
| S-1135 | CCGACAACCAGUAUUUGGACCGU | 1156 |
| S-1136 | CCGACAACCAGUAUUUGGACCGU | 1157 |
| S-1137 | CCGACAACCAGUAUUUGGAC | 1158 |
| S-1138 | CGACAACCAGUAUUUGGACC | 1159 |
| S-1139 | CCUGCUAGCACCGUGCUUACC | 1160 |

In one embodiment, the siRNA molecules of the present invention may comprise an antisense sequence from Table 2 and a sense sequence from Table 3, or a fragment or variant thereof. As a non-limiting example, the antisense sequence and the sense sequence have at least 30%, 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98% or 99% or at least 20-30%, 20-40%, 20-50%, 20-60%, 20-70%, 20-80%, 20-90%, 20-95%, 20-99%, 30-40%, 30-50%, 30-60%, 30-70%, 30-80%, 30-90%, 30-95%, 30-99%, 40-50%, 40-60%, 40-70%, 40-80%, 40-90%, 40-95%, 40-99%, 50-60%, 50-70%, 50-80%, 50-90%, 50-95%, 50-99%, 60-70%, 60-80%, 60-90%, 60-95%, 60-99%, 70-80%, 70-900%, 70-950%, 70-990%, 80-90%, 80-95%, 80-99%, 90-95%, 90-99% or 95-99% complementarity.

In one embodiment, the siRNA molecules of the present invention may comprise the sense and antisense siRNA duplex as described in Tables 4-6. As a non-limiting example, these siRNA duplexes may be tested for in vitro inhibitory activity on endogenous HTT gene expression. The start site for the sense and antisense sequence is compared to HTT gene sequence known as NM_002111.7 (SEQ ID NO: 1425) from NCBI.

TABLE 4

Sense and antisense strand sequences of HTT dsRNA

| siRNA Duplex ID | SS ID | Start SS | Sense Strand Sequence (5'-3') | SS SEQ ID | AS ID | Start AS | Antisense Strand Sequence (5'-3') | AS SEQ ID |
|---|---|---|---|---|---|---|---|---|
| D-3566 | S-1058 | 6751 | CCUGCUAGCUCCAUGCUUGCU | 1079 | A-2002 | 6751 | UAACCAUGGAGCUAGCAGGUU | 918 |
| D-3567 | S-1058 | 6751 | CCUGCUAGCUCCAUGCUUGCU | 1079 | A-2014 | 6748 | UAAGCAUGGAGCUAGCAGGCUU | 940 |
| D-3568 | S-1059 | 6751 | CCUGCUAGCUCCAUGCUUGAU | 1080 | A-2002 | 6751 | UAAGCAUGGAGCUAGCAGGUU | 918 |
| D-3569 | S-1060 | 6751 | CCUGCUAGCUCCAUGCUUAUU | 1081 | A-2015 | 6751 | UAAGCAUGGAGCUAGCAGGGU | 941 |
| D-3570 | S-1061 | 6751 | CCUGCUAGCUCCAUGCUUGUU | 1082 | A-2002 | 6751 | UAAGCAUGGAGCUAGCAGGUU | 918 |
| D-3500 | S-1016 | 1386 | UCCAGGUUUAUGAACUGACCC | 1031 | A-2004 | 1386 | UUCAGUUCAUAAACCUGGAUU | 922 |
| D-3501 | S-1023 | 1386 | UCCAGGUUUAUGAACUGAGCC | 1038 | A-2004 | 1386 | UUCAGUUCAUAAACCUGGAUU | 922 |
| D-3502 | S-1030 | 1386 | UCCAGGUUUAUGAACUGAACC | 1046 | A-2004 | 1386 | UUCAGUUCAUAAACCUGGAUU | 922 |
| D-3503 | S-1037 | 1386 | UCCAGGUUUUUGAACUGAACC | 1056 | A-2004 | 1386 | UUCAGUUCAUAAACCUGGAUU | 922 |
| D-3504 | S-1030 | 1386 | UCCAGGUUUAUGAACUGAACC | 1046 | A-2001 | 2066 | UGUCGGUACCGUCUAACACUU | 916 |
| D-3505 | S-1017 | 1390 | GGUUUAUGAACUGACGUUCCC | 1032 | A-2005 | 1389 | UAACGUCAGUUCAUAAACCUU | 924 |
| D-3506 | S-1024 | 1390 | GGUUUAUGAACUGACGUUGCC | 1039 | A-2005 | 1389 | UAACGUCAGUUCAUAAACCUU | 924 |
| D-3507 | S-1031 | 1390 | GGUUUAUGAACUGACGUUACC | 1048 | A-2005 | 1389 | UAACGUCAGUUCAUAAACCUU | 924 |
| D-3508 | S-1038 | 1390 | GGUUUAUGAUCUGACGUUACC | 1057 | A-2005 | 1389 | UAACGUCAGUUCAUAAACCUU | 924 |
| D-3509 | S-1000 | 1391 | GUUUAUGAACUGAUCUUACCC | 1014 | A-2000 | 1391 | UUAACGUCAGUUCAUAAACUU | 914 |
| D-3510 | S-1003 | 1391 | GUUUAUGAACUGAUCUUAGCC | 1017 | A-2000 | 1391 | UUAACGUCAGUUCAUAAACUU | 914 |
| D-3511 | S-1006 | 1391 | GUUUAUGAAGUGAUCUUAACC | 1020 | A-2000 | 1391 | UUAACGUCAGUUCAUAAACUU | 914 |
| D-3512 | S-1009 | 1391 | GUUUAUGAACUGAUCUUAACC | 1023 | A-2000 | 1391 | UUAACGUCAGUUCAUAAACUU | 914 |
| D-3513 | S-1012 | 1391 | GUUUAUGAACUGAUCUUGCCC | 1027 | A-2000 | 1391 | UUAACGUCAGUUCAUAAACUU | 914 |
| D-3514 | S-1013 | 1391 | GUUUAUGAACUGAUCUUGGCC | 1028 | A-2000 | 1391 | UUAACGUCAGUUCAUAAACUU | 914 |
| D-3515 | S-1014 | 1391 | GUUUAUGAACUGAUCUUGACC | 1029 | A-2000 | 1391 | UUAACGUCAGUUCAUAAACUU | 914 |
| D-3516 | S-1018 | 1429 | CCACAAUGUUGUGACUGGCCC | 1033 | A-2006 | 1428 | UCCGGUCACAACAUUGUGGUU | 926 |
| D-3517 | S-1025 | 1429 | CCACAAUGUUGUGACUGGGCC | 1040 | A-2006 | 1428 | UCCGGUCACAACAUUGUGGUU | 926 |
| D-3518 | S-1032 | 1429 | CCACAAUGUUGUGACUGGACC | 1049 | A-2006 | 1428 | UCCGGUCACAACAUUGUGGUU | 926 |

TABLE 4-continued

Sense and antisense strand sequences of HTT dsRNA

| siRNA Duplex ID | SS ID | Start SS | Sense Strand Sequence (5'-3') | SS SEQ ID | AS ID | Start AS | Antisense Strand Sequence (5'-3') | AS SEQ ID |
|---|---|---|---|---|---|---|---|---|
| D-3519 | S-1039 | 1429 | CCACAAUGUAGUGACUGGACC | 1058 | A-2006 | 1428 | UCCGGUCACAACAUUGUGGUU | 926 |
| D-3520 | S-1001 | 2066 | GUGUUAGACGGUACUGAUCCC | 1015 | A-2001 | 2066 | UGUCGGUACCGUCUAACACUU | 916 |
| D-3521 | S-1004 | 2066 | GUGUUAGACGGUACUGAUGCC | 1018 | A-2001 | 2066 | UGUCGGUACCGUCUAACACUU | 916 |
| D-3522 | S-1007 | 2066 | GUGUUAGACCGUACUGAUACC | 1021 | A-2001 | 2066 | UGUCGGUACCGUCUAACACUU | 916 |
| D-3523 | S-1010 | 2066 | GUGUUAGACGGUACUGAUACC | 1024 | A-2001 | 2066 | UGUCGGUACCGUCUAACACUU | 916 |
| D-3524 | S-1021 | 2079 | CCGACAACCAGUAUUUGGCCC | 1036 | A-2009 | 2078 | UCCAAAUACUGGUUGUCGGUU | 932 |
| D-3525 | S-1028 | 2079 | CCGACAACCAGUAUUUGGGCC | 1043 | A-2009 | 2078 | UCCAAAUACUGGUUGUCGGUU | 932 |
| D-3526 | S-1035 | 2079 | CCGACAACCAGUAUUUGGACC | 1053 | A-2009 | 2078 | UCCAAAUACUGGUUGUCGGUU | 932 |
| D-3527 | S-1042 | 2079 | CCGACAACCUGUAUUUGGACC | 1061 | A-2009 | 2078 | UCCAAAUACUGGUUGUCGGUU | 932 |
| D-3528 | S-1019 | 4544 | GUCACAAAGAACCGUGUACCC | 1034 | A-2007 | 4544 | UUGCACGGUUCUUUGUGACUU | 928 |
| D-3529 | S-1026 | 4544 | GUCACAAAGAACCGUGUAGCC | 1041 | A-2007 | 4544 | UUGCACGGUUCUUUGUGACUU | 928 |
| D-3530 | S-1033 | 4544 | GUCACAAAGAACCGUGUAACC | 1050 | A-2007 | 4544 | UUGCACGGUUCUUUGUGACUU | 928 |
| D-3531 | S-1040 | 4544 | GUCACAAAGUACCGUGUAACC | 1059 | A-2007 | 4544 | UUGCACGGUUCUUUGUGACUU | 928 |
| D-3532 | S-1020 | 4597 | UGAACCUCUUGUUAUAAACCC | 1035 | A-2008 | 4597 | UUUUAUAACAAGAGGUUCAUU | 930 |
| D-3533 | S-1027 | 4597 | UGAACCUCUUGUUAUAAAGCC | 1042 | A-2008 | 4597 | UUUUAUAACAAGAGGUUCAUU | 930 |
| D-3534 | S-1034 | 4597 | UGAACCUCUUGUUAUAAACC | 1051 | A-2008 | 4597 | UUUUAUAACAAGAGGUUCAUU | 930 |
| D-3535 | S-1041 | 4597 | UGAACCUCUAGUUAUAAACC | 1060 | A-2008 | 4597 | UUUUAUAACAAGAGGUUCAUU | 930 |
| D-3536 | S-1044 | 4861 | GAUCAUUGGAAUUCCUAAUCC | 1063 | A-2011 | 4860 | UUUAGGAAUUCCAAUGAUCUU | 936 |
| D-3537 | S-1046 | 4861 | GAUCAUUGGAAUUCCUAAGCC | 1065 | A-2011 | 4860 | UUUAGGAAUUCCAAUGAUCUU | 936 |
| D-3538 | S-1048 | 4861 | GAUCAUUGGAAUUCCUAAACC | 1068 | A-2011 | 4860 | UUUAGGAAUUCCAAUGAUCUU | 936 |
| D-3539 | S-1050 | 4861 | GAUCAUUGGUAUUCCUAAACC | 1071 | A-2011 | 4860 | UUUAGGAAUUCCAAUGAUCUU | 936 |
| D-3540 | S-1043 | 4864 | CAUUGGAAUUCCUAAAAUUCC | 1062 | A-2010 | 4864 | UAUUUAGGAAUUCCAAUGUU | 934 |
| D-3541 | S-1045 | 4864 | CAUUGGAAUUCCUAAAAUGCC | 1064 | A-2010 | 4864 | UAUUUAGGAAUUCCAAUGUU | 934 |
| D-3542 | S-1047 | 4864 | CAUUGGAAUUCCUAAAAUACC | 1066 | A-2010 | 4864 | UAUUUAGGAAUUCCAAUGUU | 934 |

TABLE 4-continued

Sense and antisense strand sequences of HTT dsRNA

| siRNA Duplex ID | SS ID | Start SS | Sense Strand Sequence (5'-3') | SS SEQ ID | AS ID | Start AS | Antisense Strand Sequence (5'-3') | AS SEQ ID |
| --- | --- | --- | --- | --- | --- | --- | --- | --- |
| D-3543 | S-1049 | 4864 | CAUUGGAAUACCUAAAAUACC | 1070 | A-2010 | 4864 | UAUUUUAGGAAUUCCAAUGUU | 934 |
| D-3544 | S-1015 | 6188 | GCAAUUCAGUCUCGUUGUCCC | 1030 | A-2003 | 6188 | UACAACGAGACUGAAUUGCUU | 920 |
| D-3545 | S-1022 | 6188 | GCAAUUCAGUCUCGUUGUGCC | 1037 | A-2003 | 6188 | UACAACGAGACUGAAUUGCUU | 920 |
| D-3546 | S-1029 | 6188 | GCAAUUCAGUCUCGUUGUACC | 1044 | A-2003 | 6188 | UACAACGAGACUGAAUUGCUU | 920 |
| D-3547 | S-1036 | 6188 | GCAAUUCAGACUCGUUGUACC | 1055 | A-2003 | 6188 | UACAACGAGACUGAAUUGCUU | 920 |
| D-3548 | S-1002 | 6751 | CCUGCUAGCUCCAUGCUUCCC | 1016 | A-2002 | 6751 | UAAGCAUGGAGCUAGCAGGUU | 918 |
| D-3549 | S-1005 | 6751 | CCUGCUAGCUCCAUGCUUGCC | 1019 | A-2002 | 6751 | UAAGCAUGGAGCUAGCAGGUU | 918 |
| D-3550 | S-1008 | 6751 | CCUGCUAGCACCAUGCUUACC | 1022 | A-2002 | 6751 | UAAGCAUGGAGCUAGCAGGUU | 918 |
| D-3551 | S-1011 | 6751 | CCUGCUAGCUCCAUGCUUACC | 1025 | A-2002 | 6751 | UAAGCAUGGAGCUAGCAGGUU | 918 |

TABLE 5

Sense and antisense strand sequences of HTT dsRNA

| siRNA Duplex ID | SS ID | Start SS | Sense Strand Sequence (5'-3') | SS SEQ ID | AS ID | Start AS | Antisense Strand Sequence (5'-3') | AS SEQ ID |
| --- | --- | --- | --- | --- | --- | --- | --- | --- |
| D-3552 | S-1051dt | 1391 | GUUUAUGAACUGACGUUAAdTdT | 1072 | A-2000dt | 1391 | UUAACGUCAGUUCAUAAACdTdT | 915 |
| D-3553 | S-1052dt | 2066 | GUGUUAGACGGUACCGACAdTdT | 1073 | A-2001dt | 2066 | UGUCGGUACCGUCUAACACdTdT | 917 |
| D-3554 | S-1011dt | 6751 | CCUGCUAGCUCCAUGCUUAdTdT | 1026 | A-2002dt | 6751 | UAAGCAUGGAGCUAGCAGGdTdT | 919 |
| D-3555 | S-1053dt | 10322 | AUAUCAGUAAAGAGAUUAAdTdT | 1074 | A-2012dt | 10322 | UUAAUCUCUUUACUGAUAUdTdT | 938 |
| D-3556 | S-1030dt | 1386 | UCCAGGUUUAUGAACUGAAdTdT | 1047 | A-2004dt | 1386 | UUCAGUUCAUAAACCUGGAdTdT | 923 |
| D-3557 | S-1054dt | 1390 | GGUUUAUGAACUGACGUUAdTdT | 1075 | A-2005dt | 1390 | UAACGUCAGUUCAUAAACCdTdT | 925 |
| D-3558 | S-1055dt | 1429 | CCACAAUGUUGUGACCGGAdTdT | 1076 | A-2006dt | 1429 | UCCGGUCACAACAUUGUGGdTdT | 927 |
| D-3559 | S-1035dt | 2079 | CCGACAACCAGUAUUUGGAdTdT | 1054 | A-2009dt | 2079 | UCCAAAUACUGGUUGUCGGdTdT | 933 |
| D-3560 | S-1056dt | 4544 | GUCACAAAGAACCGUGCAAdTdT | 1077 | A-2007dt | 4544 | UUGCACGGUUCUUUGUGACdTdT | 929 |
| D-3561 | S-1034dt | 4597 | UGAACCUCUUGUUAUAAAAdTdT | 1052 | A-2008dt | 4597 | UUUUAUAACAAGAGGUUCAdTdT | 931 |
| D-3562 | S-1029dt | 6188 | GCAAUUCAGUCUCGUUGUAdTdT | 1045 | A-2003dt | 6188 | UACAACGAGACUGAAUUGCdTdT | 921 |

TABLE 5-continued

Sense and antisense strand sequences of HTT dsRNA

| siRNA Duplex ID | SS ID | Start SS | Sense Strand Sequence (5'-3') | SS SEQ ID | AS ID | Start AS | Antisense Strand Sequence (5'-3') | AS SEQ ID |
|---|---|---|---|---|---|---|---|---|
| D-3563 | S-1047dt | 4864 | CAUUGGAAUUCC UAAAAUAdTdT | 1067 | A-2010dt | 4864 | UAUUUUAGGAAU UCCAAUGdTdT | 935 |
| D-3564 | S-1048dt | 4861 | GAUCAUUGGAAU UCCUAAAdTdT | 1069 | A-2011dt | 4861 | UUUAGGAAUUCC AAUGAUCdTdT | 937 |
| D-3565 | S-1057dt | 4864 | CAUUGGAAUUCC UAAAAUCdTdT | 1078 | A-2013dt | 4864 | GAUUUUAGGAAU UCCAAUGdTdT | 939 |

TABLE 6

Antisense and Sense strand sequences of HTT dsRNA

| siRNA Duplex ID | AS ID | Start AS | Antisense Strand Sequence (5'-3') | AS SEQ ID | SS ID | Start SS | Sense Strand Sequence (5'-3') | SS SEQ ID |
|---|---|---|---|---|---|---|---|---|
| D-3569 | S-1060 | 6751 | CCUGCUAGCUC CAUGCUUAUU | 1081 | A-2015 | 6751 | UAAGCAUGGAG CUAGCAGGGU | 941 |
| D-3570 | S-1061 | 6751 | CCUGCUAGCUC CAUGCUUGUU | 1082 | A-2002 | 6751 | UAAGCAUGGAG CUAGCAGGUU | 918 |

In other embodiments, the siRNA molecules of the present invention can be encoded in plasmid vectors, AAV particles, viral genome or other nucleic acid expression vectors for delivery to a cell.

DNA expression plasmids can be used to stably express the siRNA duplexes or dsRNA of the present invention in cells and achieve long-term inhibition of the target gene expression. In one aspect, the sense and antisense strands of a siRNA duplex are typically linked by a short spacer sequence leading to the expression of a stem-loop structure termed short hairpin RNA (shRNA). The hairpin is recognized and cleaved by Dicer, thus generating mature siRNA molecules.

According to the present invention, AAV particles comprising the nucleic acids encoding the siRNA molecules targeting HTT mRNA are produced, the AAV serotypes may be any of the serotypes listed in Table 1. Non-limiting examples of the AAV serotypes include, AAV1, AAV2, AAV3, AAV4, AAV5, AAV6, AAV7, AAV8, AAV9, AAV9.47, AAV9(hu14), AAV10, AAV11, AAV12, AAVrh8, AAVrh10, AAV-DJ8, AAV-DJ, AAV-PHP.A, and/or AAV-PHP.B, and variants thereof.

In some embodiments, the siRNA duplexes or encoded dsRNA of the present invention suppress (or degrade) target mRNA (e.g., HTT). Accordingly, the siRNA duplexes or encoded dsRNA can be used to substantially inhibit HTT gene expression in a cell, for example a neuron. In some aspects, the inhibition of HTT gene expression refers to an inhibition by at least about 20%, preferably by at least about 30%, 40%, 50%, 60%, 70%, 80%, 85%, 90%, 95% and 100%, or at least 20-30%, 20-40%, 20-50%, 20-600%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%. Accordingly, the protein product of the targeted gene may be inhibited by at least about 20%, preferably by at least about 30%, 40%, 50%, 60%, 70%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%.

According to the present invention, the siRNA molecules are designed and tested for their ability in reducing HTT mRNA levels in cultured cells. Such siRNA molecules may form a duplex such as, but not limited to, include those listed in Table 4, Table 5 or Table 6. As a non-limiting example, the siRNA duplexes may be siRNA duplex IDs: D-3500 to D-3570.

In one embodiment, the siRNA molecules comprise a miRNA seed match for the target (e.g., HTT) located in the guide strand. In another embodiment, the siRNA molecules comprise a miRNA seed match for the target (e.g., HTT) located in the passenger strand. In yet another embodiment, the siRNA duplexes or encoded dsRNA targeting HTT gene do not comprise a seed match for the target (e.g., HTT) located in the guide or passenger strand.

In one embodiment, the siRNA duplexes or encoded dsRNA targeting HTT gene may have almost no significant full-length off target effects for the guide strand. In another embodiment, the siRNA duplexes or encoded dsRNA targeting HTT gene may have almost no significant full-length off target effects for the passenger strand. The siRNA duplexes or encoded dsRNA targeting HTT gene may have less than 1%, 2%, 3%, 4%, 5%, 6%, 7%, 8%, 9%, 10%,11%, 12%, 13%, 14%, 15%, 20%, 25%, 30%, 35%, 40%, 45%, 50%, 1-5%, 2-6%, 3-7%, 4-8%, 5-9%, 5-10%, 6-10%, 5-15%, 5-20%, 5-25%, 5-30%, 10-20%, 10-30%, 10-40%, 10-50%, 15-30%, 15-40%, 15-45%, 20-40%, 20-50%, 25-50%, 30-40%, 30-50%, 35-50%, 40-50%, 45-50% full-length off target effects for the passenger strand. In yet another embodiment, the siRNA duplexes or encoded dsRNA targeting HTT gene may have almost no significant full-length off target effects for the guide strand or the passenger strand. The siRNA duplexes or encoded dsRNA targeting HTT gene may have less than 1%, 2%, 3%, 4%, 5%, 6%, 7%, 8%, 9%, 10%, 11, 12%, 13%, 14%, 15%, 20%, 25%, 30%, 35%, 40%, 45%, 50%, 1-5%, 2-6%, 3-7%, 4-8%, 5-9%, 5-10%, 6-10%, 5-15%, 5-20%, 5-25%, 5-30%, 10-20%, 10-30%, 10-40%, 10-50%, 15-30%, 15-40%, 15-45%, 20-40%, 20-50%, 25-50%, 30-40%, 30-50%, 35-50%, 40-50%, 45-50% full-length off target effects for the guide or passenger strand.

In one embodiment, the siRNA duplexes or encoded dsRNA targeting HTT gene may have high activity in vitro. In another embodiment, the siRNA molecules may have low activity in vitro. In yet another embodiment, the siRNA duplexes or dsRNA targeting the HTT gene may have high guide strand activity and low passenger strand activity in vitro.

In one embodiment, the siRNA molecules have a high guide strand activity and low passenger strand activity in vitro. The target knock-down (KD) by the guide strand may be at least 40%, 50%, 60%, 65%, 70%, 75%, 80%, 85%, 90%, 95%, 99%, 99.5% or 100%. The target knock-down by the guide strand may be 40-50%, 45-50%, 50-55%, 50-60%, 60-65%, 60-70%, 60-75%, 60-80%, 60-85%, 60-90%, 60-95%, 60-99%, 60-99.5%, 60-100%, 65-70%, 65-75%, 65-80%, 65-85%, 65-90%, 65-95%, 65-99%, 65-99.5%, 65-100%, 70-75%, 70-80%, 70-85%, 70-90%, 70-95%, 70-99%, 70-99.5%, 70-100%, 75-80%, 75-85%, 75-90%, 75-95%, 75-99%, 75-99.5%, 75-100%, 80-85%, 80-90%, 80-95%, 80-99%, 80-99.5%, 80-100%, 85-90%, 85-95%, 85-99%, 85-99.5%, 85-100%, 90-95%, 90-99%, 90-99.5%, 90-100%, 95-99%, 95-99.5%, 95-1000%, 99-99.5%, 99-100% or 99.5-100%. As a non-limiting example, the target knock-down (KD) by the guide strand is greater than 70%. As a non-limiting example, the target knock-down (KD) by the guide strand is greater than 60%.

In one embodiment, the siRNA duplex is designed so there is no miRNA seed match for the sense or antisense sequence to non-Htt sequence.

In one embodiment, the $IC_{50}$ of the guide strand for the nearest off target is greater than 100 multiplied by the $IC_{50}$ of the guide strand for the on-target gene, Htt. As a non-limiting example, if the $IC_{50}$ of the guide strand for the nearest off target is greater than 100 multiplied by the $IC_{50}$ of the guide strand for the target then the siRNA molecule is said to have high guide strand selectivity for inhibiting Htt in vitro.

In one embodiment, the 5' processing of the guide strand has a correct start (n) at the 5' end at least 75%, 80%, 85%, 90%, 95%, 99% or 100% of the time in vitro or in vivo. As a non-limiting example, the 5' processing of the guide strand is precise and has a correct start (n) at the 5' end at least 99% of the time in vitro. As a non-limiting example, the 5' processing of the guide strand is precise and has a correct start (n) at the 5' end at least 99% of the time in vivo. As a non-limiting example, the 5' processing of the guide strand is precise and has a correct start (n) at the 5' end at least 90% of the time in vitro. As a non-limiting example, the 5' processing of the guide strand is precise and has a correct start (n) at the 5' end at least 90% of the time in vivo. As a non-limiting example, the 5' processing of the guide strand is precise and has a correct start (n) at the 5' end at least 85% of the time in vitro. As a non-limiting example, the 5' processing of the guide strand is precise and has a correct start (n) at the 5' end at least 85% of the time in vivo.

In one embodiment, the guide to passenger (G:P) (also referred to as the antisense to sense) strand ratio expressed is 1:10, 1:9, 1:8, 1:7, 1:6, 1:5, 1:4, 1:3, 1:2, 1.1, 2:10, 2:9, 2:8, 2:7, 2:6, 2:5, 2:4, 2:3, 2:2, 2:1, 3:10, 3:9, 3:8, 3:7, 3:6, 3:5, 3:4, 3:3, 3:2, 3:1, 4:10, 4:9, 4:8, 4:7, 4:6, 4:5, 4:4, 4:3, 4:2, 4:1, 5:10, 5:9, 5:8, 5:7, 5:6, 5:5, 5:4, 5:3, 5:2, 5:1, 6:10, 6:9, 6:8, 6:7, 6:6, 6:5, 6:4, 6:3, 6:2, 6:1, 7:10, 7:9, 7:8, 7:7, 7:6, 7:5, 7:4, 7:3, 7:2, 7:1, 8:10, 8:9, 8:8, 8:7, 8:6, 8:5, 8:4, 8:3, 8:2, 8:1, 9:10, 9:9, 9:8, 9:7, 9:6, 9:5, 9:4, 9:3, 9:2, 9:1, 10:10, 10:9, 10:8, 10:7, 10:6, 10:5, 10:4, 10:3, 10:2, 10:1, 1:99, 5:95, 10:90, 15:85, 20:80, 25:75, 30:70, 35:65, 40:60, 45:55, 50:50, 55:45, 60:40, 65:35, 70:30, 75:25, 80:20, 85:15, 90:10, 95:5, or 99:1 in vitro or m vivo. The guide to passenger ratio refers to the ratio of the guide strands to the passenger strands after intracellular processing of the pri-microRNA. For example, a 80:20 guide-to-passenger ratio would have 8 guide strands to every 2 passenger strands processed from the precursor. As a non-limiting example, the guide-to-passenger strand ratio is 8:2 in vitro. As a non-limiting example, the guide-to-passenger strand ratio is 8:2 in vivo. As a non-limiting example, the guide-to-passenger strand ratio is 9:1 in vitro. As a non-limiting example, the guide-to-passenger strand ratio is 9:1 in vivo.

In one embodiment, the guide to passenger (G:P) (also referred to as the antisense to sense) strand ratio expressed is greater than 1.

In one embodiment, the guide to passenger (G:P) (also referred to as the antisense to sense) strand ratio expressed is greater than 2.

In one embodiment, the guide to passenger (G:P) (also referred to as the antisense to sense) strand ratio expressed is greater than 5.

In one embodiment, the guide to passenger (G:P) (also referred to as the antisense to sense) strand ratio expressed is greater than 10.

In one embodiment, the guide to passenger (G:P) (also referred to as the antisense to sense) strand ratio expressed is greater than 20.

In one embodiment, the guide to passenger (G:P) (also referred to as the antisense to sense) strand ratio expressed is greater than 50.

In one embodiment, the guide to passenger (G:P) (also referred to as the antisense to sense) strand ratio expressed is at least 3:1.

In one embodiment, the guide to passenger (G:P) (also referred to as the antisense to sense) strand ratio expressed is at least 5:1.

In one embodiment, the guide to passenger (G:P) (also referred to as the antisense to sense) strand ratio expressed is at least 10:1.

In one embodiment, the guide to passenger (G:P) (also referred to as the antisense to sense) strand ratio expressed is at least 20:1.

In one embodiment, the guide to passenger (G:P) (also referred to as the antisense to sense) strand ratio expressed is at least 50:1.

In one embodiment, the passenger to guide (P:G) (also referred to as the sense to antisense) strand ratio expressed is 1:10, 1:9, 1:8, 1:7, 1:6, 1:5, 1:4, 1:3, 1:2, 1, 1, 2:10, 2:9, 2:8, 2:7, 2:6, 2:5, 2:4, 2:3, 2:2, 2:1, 3:10, 3:9, 3:8, 3:7, 3:6, 3:5, 3:4, 3:3, 3:2, 3:1, 4:10, 4:9, 4:8, 4:7, 4:6, 4:5, 4:4, 4:3, 4:2, 4:1, 5:10, 5:9, 5:8, 5:7, 5:6, 5:5, 5:4, 5:3, 5:2, 5:1, 6:10, 6:9, 6:8, 6:7, 6:6, 6:5, 6:4, 6:3, 6:2, 6:1, 7:10, 7:9, 7:8, 7:7, 7:6, 7:5, 7:4, 7:3, 7:2, 7:1, 8:10, 8:9, 8:8, 8:7, 8:6, 8:5, 8:4, 8:3, 8:2, 8:1, 9:10, 9:9, 9:8, 9:7, 9:6, 9:5, 9:4, 9:3, 9:2, 9:1, 10:10, 10:9, 10:8, 10:7, 10:6, 10:5, 10:4, 10:3, 10:2, 10:1, 1:99, 5:95, 10:90, 15:85, 20:80, 25:75, 30:70, 35:65, 40:60, 45:55, 50:50, 55:45, 60:40, 65:35, 70:30, 75:25, 80:20, 85:15, 90:10, 95:5, or 99:1 in vitro or in vivo. The passenger to guide ratio refers to the ratio of the passenger strands to the guide strands after the intracellular processing of the pri-microRNA. For example, a 80:20 of passenger-to-guide ratio would have 8 passenger strands to every 2 guide strands processed from the precursor. As a non-limiting example, the passenger-to-guide strand ratio is 80:20 in vitro. As a non-limiting example, the passenger-to-guide strand ratio is 80:20 in vivo. As a non-limiting example, the passenger-to-guide strand ratio is 8:2 in vitro. As a non-limiting example, the passenger-to-guide strand ratio is 8:2 in vivo. As a non-limiting example, the passenger-to-guide strand ratio is 9:1 m vitro. As a non-limiting example, the passenger-to-guide strand ratio is 9:1 in vivo.

In one embodiment, the passenger to guide (P:G) (also referred to as the sense to antisense) strand ratio expressed is greater than 1.

In one embodiment, the passenger to guide (P:G) (also referred to as the sense to antisense) strand ratio expressed is greater than 2.

In one embodiment, the passenger to guide (P:G) (also referred to as the sense to antisense) strand ratio expressed is greater than 5.

In one embodiment, the passenger to guide (P:G) (also referred to as the sense to antisense) strand ratio expressed is greater than 10.

In one embodiment, the passenger to guide (P:G) (also referred to as the sense to antisense) strand ratio expressed is greater than 20.

In one embodiment, the passenger to guide (P:G) (also referred to as the sense to antisense) strand ratio expressed is greater than 50.

In one embodiment, the passenger to guide (P:G) (also referred to as the sense to antisense) strand ratio expressed is at least 3:1.

In one embodiment, the passenger to guide (P:G) (also referred to as the sense to antisense) strand ratio expressed is at least 5:1.

In one embodiment, the passenger to guide (P:G) (also referred to as the sense to antisense) strand ratio expressed is at least 10:1.

In one embodiment, the passenger to guide (P:G) (also referred to as the sense to antisense) strand ratio expressed is at least 20:1.

In one embodiment, the passenger to guide (P:G) (also referred to as the sense to antisense) strand ratio expressed is at least 50:1.

In one embodiment, a passenger-guide strand duplex is considered effective when the pri- or pre-microRNAs demonstrate, but methods known in the art and described herein, greater than 2-fold guide to passenger strand ratio when processing is measured. As a non-limiting examples, the pri- or pre-microRNAs demonstrate great than 2-fold, 3-fold, 4-fold, 5-fold, 6-fold, 7-fold, 8-fold, 9-fold, 10-fold, 11-fold, 12-fold, 13-fold, 14-fold, 15-fold, or 2 to 5-fold, 2 to 10-fold, 2 to 15-fold, 3 to 5-fold, 3 to 10-fold, 3 to 15-fold, 4 to 5-fold, 4 to 10-fold, 4 to 15-fold, 5 to 10-fold, 5 to 15-fold, 6 to 10-fold, 6 to 15-fold, 7 to 10-fold, 7 to 15-fold, 8 to 10-fold, 8 to 15-fold, 9 to 10-fold, 9 to 15-fold, 10 to 15-fold, 11 to 15-fold, 12 to 15-fold, 13 to 15-fold, or 14 to 15-fold guide to passenger strand ratio when processing is measured.

In one embodiment, the vector genome encoding the dsRNA comprises a sequence which is at least 60%, 65%, 70%, 75%, 80%, 85%, 90%, 95%, 99% or more than 99% of the full length of the construct. As a non-limiting example, the vector genome comprises a sequence which is at least 80% of the full length sequence of the construct.

In one embodiment, the siRNA molecules may be used to silence wild type or mutant HTT by targeting at least one exon on the htt sequence. The exon may be exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, and/or exon 67. As a non-limiting example, the siRNA molecules may be used to silence wild type or mutant HTT by targeting exon 1. As another non-limiting example, the siRNA molecules may be used to silence wild type or mutant HTT by targeting an exon other than exon 1. As another non-limiting example, the siRNA molecules may be used to silence wild type or mutant HTT by targeting exon 50. As another non-limiting example, the siRNA molecules may be used to silence wild type or mutant HTT by targeting exon 67.

In one embodiment, the siRNA molecules may be used to silence wild type and/or mutant HTT by targeting at least one exon on the htt sequence. The exon may be exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, and/or exon 67. As a non-limiting example, the siRNA molecules may be used to silence wild type and/or mutant HTT by targeting exon 1. As another non-limiting example, the siRNA molecules may be used to silence wild type and/or mutant HTT by targeting an exon other than exon 1. As another non-limiting example, the siRNA molecules may be used to silence wild type and/or mutant HTT by targeting exon 50. As another non-limiting example, the siRNA molecules may be used to silence wild type and/or mutant HTT by targeting exon 67.

siRNA Modification

In some embodiments, the siRNA molecules of the present invention, when not delivered as a precursor or DNA, may be chemically modified to modulate some features of RNA molecules, such as, but not limited to, increasing the stability of siRNAs in vivo. The chemically modified siRNA molecules can be used in human therapeutic applications, and are improved without compromising the RNAi activity of the siRNA molecules. As a non-limiting example, the siRNA molecules modified at both the 3' and the 5' end of both the sense strand and the antisense strand.

In some aspects, the siRNA duplexes of the present invention may contain one or more modified nucleotides such as, but not limited to, sugar modified nucleotides, nucleobase modifications and/or backbone modifications. In some aspects, the siRNA molecule may contain combined modifications, for example, combined nucleobase and backbone modifications.

In one embodiment, the modified nucleotide may be a sugar-modified nucleotide. Sugar modified nucleotides include, but are not limited to 2'-fluoro, 2'-amino and 2'-thio modified ribonucleotides, e.g. 2'-fluoro modified ribonucleotides. Modified nucleotides may be modified on the sugar moiety, as well as nucleotides having sugars or analogs thereof that are not ribosyl. For example, the sugar moieties may be, or be based on, mannoses, arabinoses, glucopyranoses, galactopyranoses, 4'-thioribose, and other sugars, heterocycles, or carbocycles.

In one embodiment, the modified nucleotide may be a nucleobase-modified nucleotide.

In one embodiment, the modified nucleotide may be a backbone-modified nucleotide. In some embodiments, the siRNA duplexes of the present invention may further comprise other modifications on the backbone. A normal "backbone", as used herein, refers to the repeating alternating sugar-phosphate sequences in a DNA or RNA molecule. The deoxyribose/ribose sugars are joined at both the 3'-hydroxyl and 5'-hydroxyl groups to phosphate groups in ester links, also known as "phosphodiester" bonds/linker (PO linkage). The PO backbones may be modified as "phosphorothioate backbone (PS linkage). In some cases, the natural phosphodiester bonds may be replaced by amide bonds but the four atoms between two sugar units are kept. Such amide modifications can facilitate the solid phase synthesis of oligonucleotides and increase the thermodynamic stability of a duplex formed with siRNA complement. See e.g. Mesmaeker et al., *Pure & Appl. Chem.*, 1997, 3, 437-440; the content of which is incorporated herein by reference in its entirety.

Modified bases refer to nucleotide bases such as, for example, adenine, guanine, cytosine, thymine, uracil, xanthine, inosine, and queuosine that have been modified by the replacement or addition of one or more atoms or groups. Some examples of modifications on the nucleobase moieties include, but are not limited to, alkylated, halogenated, thiolated, aminated, amidated, or acetylated bases, individually or in combination. More specific examples include, for example, 5-propynyluridine, 5-propynylcytidine, 6-methyladenine, 6-methylguanine, N,N,-dimethyladenine, 2-propyladenine, 2-propylguanine, 2-aminoadenine, 1-methylinosine, 3-methyluridine, 5-methylcytidine, 5-methyluridine and other nucleotides having a modification at the 5 position, 5-(2-amino)propyl uridine, 5-halocytidine, 5-halouridine, 4-acetylcytidine, 1-methyladenosine, 2-methyladenosine, 3-methylcytidine, 6-methyluridine, 2-methylguanosine, 7-methylguanosine, 2,2-dimethylguanosine, 5-methylaminoethyluridine, 5-methyloxyuridine, deazanucleotides such as 7-deaza-adenosine, 6-azouridine, 6-azocytidine, 6-azothymidine, 5-methyl-2-thiouridine, other thio bases such as 2-thiouridine and 4-thiouridine and 2-thiocytidine, dihydrouridine, pseudouridine, queuosine, archaeosine, naphthyl and substituted naphthyl groups, any O- and N-alkylated purines and pyrimidines such as N6-methyladenosine, 5-methylcarbonylmethyluridine, uridine 5-oxyacetic acid, pyridine-4-one, pyridine-2-one, phenyl and modified phenyl groups such as aminophenol or 2,4,6-trimethoxy benzene, modified cytosines that act as G-clamp nucleotides, 8-substituted adenines and guanines, 5-substituted uracils and thymines, azapyrimidines, carboxyhydroxyalkyl nucleotides, carboxyalkylaminoalkyl nucleotides, and alkylcarbonylalkylated nucleotides.

In one embodiment, the modified nucleotides may be on just the sense strand.

In another embodiment, the modified nucleotides may be on just the antisense strand.

In some embodiments, the modified nucleotides may be in both the sense and antisense strands.

In some embodiments, the chemically modified nucleotide does not affect the ability of the antisense strand to pair with the target mRNA sequence, such as the HTT mRNA sequence.

In one embodiment, the AAV particle comprising a nucleic acid sequence encoding the siRNA molecules of the present invention may encode siRNA molecules which are polycistronic molecules. The siRNA molecules may additionally comprise one or more linkers between regions of the siRNA molecules.

Molecular Scaffold

In one embodiment, the siRNA molecules may be encoded in a modulatory polynucleotide which also comprises a molecular scaffold. As used herein a "molecular scaffold" is a framework or starting molecule that forms the sequence or structural basis against which to design or make a subsequent molecule.

In one embodiment, the molecular scaffold comprises at least one 5' flanking region. As a non-limiting example, the 5' flanking region may comprise a 5' flanking sequence which may be of any length and may be derived in whole or in part from wild type microRNA sequence or be a completely artificial sequence.

In one embodiment, the molecular scaffold comprises at least one 3' flanking region. As a non-limiting example, the 3' flanking region may comprise a 3' flanking sequence which may be of any length and may be derived in whole or in part from wild type microRNA sequence or be a completely artificial sequence.

In one embodiment, the molecular scaffold comprises at least one loop motif region. As a non-limiting example, the loop motif region may comprise a sequence which may be of any length.

In one embodiment, the molecular scaffold comprises a 5' flanking region, a loop motif region and/or a 3' flanking region.

In one embodiment, at least one siRNA, miRNA or other RNAi agent described herein, may be encoded by a modulatory polynucleotide which may also comprise at least one molecular scaffold. The molecular scaffold may comprise a 5' flanking sequence which may be of any length and may be derived in whole or in part from wild type microRNA sequence or be completely artificial. The 3' flanking sequence may mirror the 5' flanking sequence and/or a 3' flanking sequence in size and origin. Either flanking sequence may be absent. The 3' flanking sequence may optionally contain one or more CNNC motifs, where "N" represents any nucleotide.

Forming the stem of a stem loop structure is a minimum of the modulatory polynucleotide encoding at least one siRNA, miRNA or other RNAi agent described herein. In some embodiments, the siRNA, miRNA or other RNAi agent described herein comprises at least one nucleic acid sequence which is in part complementary or will hybridize to a target sequence. In some embodiments the payload is an siRNA molecule or fragment of an siRNA molecule.

In some embodiments, the 5' arm of the stem loop structure of the modulatory polynucleotide comprises a nucleic acid sequence encoding a sense sequence. Non-limiting examples of sense sequences, or fragments or variants thereof, which may be encoded by the modulatory polynucleotide are described in Table 3.

In some embodiments, the 3' arm of the stem loop of the modulatory polynucleotide comprises a nucleic acid sequence encoding an antisense sequence. The antisense sequence, in some instances, comprises a "G" nucleotide at the 5' most end. Non-limiting examples of antisense sequences, or fragments or variants thereof, which may be encoded by the modulatory polynucleotide are described in Table 2.

In other embodiments, the sense sequence may reside on the 3' arm while the antisense sequence resides on the 5' arm of the stem of the stem loop structure of the modulatory polynucleotide. Non-limiting examples of sense and anti-sense sequences which may be encoded by the modulatory polynucleotide are described in Tables 2 and 3.

In one embodiment, the sense and antisense sequences may be completely complementary across a substantial portion of their length. In other embodiments the sense sequence and antisense sequence may be at least 70, 80, 90, 95 or 99% complementarity across independently at least 50, 60, 70, 80, 85, 90, 95, or 99% of the length of the strands.

Neither the identity of the sense sequence nor the homology of the antisense sequence need to be 100% complementarity to the target sequence.

In one embodiment, separating the sense and antisense sequence of the stem loop structure of the modulatory polynucleotide is a loop sequence (also known as a loop motif, linker or linker motif). The loop sequence may be of any length, between 4-30 nucleotides, between 4-20 nucleotides, between 4-15 nucleotides, between 5-15 nucleotides, between 6-12 nucleotides, 6 nucleotides, 7 nucleotides, 8 nucleotides, 9 nucleotides, 10 nucleotides, 11 nucleotides, 12 nucleotides, 13 nucleotides, 14 nucleotides, and/or 15 nucleotides.

In some embodiments, the loop sequence comprises a nucleic acid sequence encoding at least one UGUG motif. In some embodiments, the nucleic acid sequence encoding the UGUG motif is located at the 5' terminus of the loop sequence.

In one embodiment, spacer regions may be present in the modulatory polynucleotide to separate one or more modules (e.g., 5' flanking region, loop motif region, 3' flanking region, sense sequence, antisense sequence) from one another. There may be one or more such spacer regions present.

In one embodiment, a spacer region of between 8-20, i.e., 8, 9, 10, 11, 12, 13, 14, 15, 16, 17, 18, 19, or 20 nucleotides may be present between the sense sequence and a flanking region sequence.

In one embodiment, the length of the spacer region is 13 nucleotides and is located between the 5' terminus of the sense sequence and the 3' terminus of the flanking sequence. In one embodiment, a spacer is of sufficient length to form approximately one helical turn of the sequence.

In one embodiment, a spacer region of between 8-20, i.e., 8, 9, 10, 11, 12, 13, 14, 15, 16, 17, 18, 19, or 20 nucleotides may be present between the antisense sequence and a flanking sequence.

In one embodiment, the spacer sequence is between 10-13, i.e., 10, 11, 12 or 13 nucleotides and is located between the 3' terminus of the antisense sequence and the 5' terminus of a flanking sequence. In one embodiment, a spacer is of sufficient length to form approximately one helical turn of the sequence.

In one embodiment, the molecular scaffold of the modulatory polynucleotide comprises in the 5' to 3' direction, a 5' flanking sequence, a 5' arm, a loop motif, a 3' arm and a 3' flanking sequence. As a non-limiting example, the 5' arm may comprise a nucleic acid sequence encoding a sense sequence and the 3' arm comprises a nucleic acid sequence encoding the antisense sequence. In another non-limiting example, the 5' arm comprises a nucleic acid sequence encoding the antisense sequence and the 3' arm comprises a nucleic acid sequence encoding the sense sequence.

In one embodiment, the 5' arm, sense and/or antisense sequence, loop motif and/or 3' arm sequence may be altered (e.g., substituting 1 or more nucleotides, adding nucleotides and/or deleting nucleotides). The alteration may cause a beneficial change in the function of the construct (e.g., increase knock-down of the target sequence, reduce degradation of the construct, reduce off target effect, increase efficiency of the payload, and reduce degradation of the payload).

In one embodiment, the molecular scaffold of the modulatory polynucleotides is aligned in order to have the rate of excision of the guide strand (also referred to herein as the antisense strand) be greater than the rate of excision of the passenger strand (also referred to herein as the sense strand). The rate of excision of the guide or passenger strand may be, independently, 1%, 2%, 3%, 4%, 5%, 10%, 15%, 20%, 25%, 30%, 35%, 40%, 45%, 50%, 55%, 60%, 65%, 70%, 75%, 80%, 85%, 90%, 95%, 99% or more than 99%. As a non-limiting example, the rate of excision of the guide strand is at least 80%. As another non-limiting example, the rate of excision of the guide strand is at least 90%.

In one embodiment, the rate of excision of the guide strand is greater than the rate of excision of the passenger strand. In one aspect, the rate of excision of the guide strand may be at least 1%, 2%, 3%, 4%, 5%, 10%, 15%, 20%, 25%, 30%, 35%, 40%, 45%, 50%, 55%, 60%, 65%, 70%, 75%, 80%, 85%, 90%, 95%, 99% or more than 99% greater than the passenger strand.

In one embodiment, the efficiency of excision of the guide strand is at least 60%, 65%, 70%, 75%, 80%, 85%, 90%, 95%, 99% or more than 99%. As a non-limiting example, the efficiency of the excision of the guide strand is greater than 80%.

In one embodiment, the efficiency of the excision of the guide strand is greater than the excision of the passenger strand from the molecular scaffold. The excision of the guide strand may be 2, 3, 4, 5, 6, 7, 8, 9, 10 or more than 10 times more efficient than the excision of the passenger strand from the molecular scaffold.

In one embodiment, the molecular scaffold comprises a dual-function targeting modulatory polynucleotide. As used herein, a "dual-function targeting" modulatory polynucleotide is a polynucleotide where both the guide and passenger strands knock down the same target or the guide and passenger strands knock down different targets.

In one embodiment, the molecular scaffold of the modulatory polynucleotides described herein may comprise a 5' flanking region, a loop motif region and a 3' flanking region. Non-limiting examples of the sequences for the 5' flanking region, loop motif region (may also be referred to as a linker region) and the 3' flanking region which may be used, or fragments thereof used, in the modulatory polynucleotides described herein are shown in Tables 7-9.

TABLE 7

5' Flanking Regions for Molecular Scaffold

| 5' Flanking Region Name | 5' Flanking Region Sequence | 5' Flanking Region SEQ ID |
|---|---|---|
| 5F3 | GTGCTGGGCGGGGGCGGCGGGCCCTCCCGCAGAACACCATGCGCTCCACGGAA | 1163 |
| 5F1 | GTGCTGGGCGGGGGCGGCGGGCCCTCCCGCAGAACACCATGCGCTCTTCGGAA | 1161 |
| 5F2 | GAAGCAAAGAAGGGGCAGAGGGAGCCCGTGAGCTGAGTGGGCCAGGGACTGGGAGAAGGAGTGAGGAGGCAGGGCCGGCATGCCTCTGCTGCTGGCCAGA | 1162 |
| 5F4 | GGGCCCTCCCGCAGAACACCATGCGCTCCACGGAA | 1164 |
| 5F5 | CTCCCGCAGAACACCATGCGCTCCACGGAA | 1165 |
| 5F6 | GTGCTGGGCGGGGGCGGCGGGCCCTCCCGCAGAACACCATGCGCTCCACGGAAG | 1166 |
| 5F7 | GTGCTGGGCGGGGGCGGCGGGCCCTCCCGCAGAACACCATGCGCTCCTCGGAA | 1167 |

TABLE 8

Loop Motif Regions for Molecular Scaffold

| Loop Motif Region Name | Loop Motif Region Sequence | Loop Motif Region SEQ ID |
|---|---|---|
| L5 | GTGGCCACTGAGAAG | 1172 |
| L1 | TGTGACCTGG | 1168 |
| L2 | TGTGATTTGG | 1169 |
| L3 | GTCTGCACCTGTCACTAG | 1170 |
| L4 | GTGACCCAAG | 1171 |
| L6 | GTGACCCAAT | 1173 |
| L7 | GTGACCCAAC | 1174 |
| L8 | GTGGCCACTGAGAAA | 1175 |

TABLE 9

3' Flanking Regions for Molecular Scaffold

| 3' Flanking Region Name | 3' Flanking Region Sequence | 3' Flanking Region SEQ ID |
|---|---|---|
| 3F1 | CTGAGGAGCGCCTTGACAGCAGCCATGGGAGGGCCGCCCCCTACCTCAGTGA | 1178 |
| 3F2 | CTGTGGAGCGCCTTGACAGCAGCCATGGGAGGGCCGCCCCCTACCTCAGTGA | 1179 |
| 3F3 | TGGCCGTGTAGTGCTACCCAGCGCTGGCTGCCTCCTCAGCATTGCAATTCCTCTCCCATCTGGGCACCAGTCAGCTACCCTGGTGGGAATCTGGGTAGCC | 1180 |
| 3F4 | CTGAGGAGCGCCTTGACAGCAGCCATGGGAGGGCC | 1181 |
| 3F5 | CTGCGGAGCGCCTTGACAGCAGCCATGGGAGGGCCGCCCCCTACCTCAGTGA | 1182 |

In one embodiment, the molecular scaffold may comprise at least one 5' flanking region, fragment or variant thereof listed in Table 7. As a non-limiting example, the 5' flanking region may be 5F1, 5F2, 5F3, 5F4, 5F5, 5F6, or 5F7.

In one embodiment, the molecular scaffold may comprise at least one 5F1 flanking region.

In one embodiment, the molecular scaffold may comprise at least one 5F2 flanking region.

In one embodiment, the molecular scaffold may comprise at least one 5F3 flanking region.

In one embodiment, the molecular scaffold may comprise at least one 5F4 flanking region.

In one embodiment, the molecular scaffold may comprise at least one 5F5 flanking region.

In one embodiment, the molecular scaffold may comprise at least one 5F6 flanking region.

In one embodiment, the molecular scaffold may comprise at least one 5F7 flanking region.

In one embodiment, the molecular scaffold may comprise at least one loop motif region, fragment or variant thereof listed in Table 8. As a non-limiting example, the loop motif region may be L1, L2, L3, LA, L5, L6, L7, or L8.

In one embodiment, the molecular scaffold may comprise at least one L1 loop motif region.

In one embodiment, the molecular scaffold may comprise at least one L2 loop motif region.

In one embodiment, the molecular scaffold may comprise at least one L3 loop motif region.

In one embodiment, the molecular scaffold may comprise at least one L4 loop motif region.

In one embodiment, the molecular scaffold may comprise at least one L5 loop motif region.

In one embodiment, the molecular scaffold may comprise at least one L6 loop motif region.

In one embodiment, the molecular scaffold may comprise at least one L7 loop motif region.

In one embodiment, the molecular scaffold may comprise at least one L8 loop motif region.

In one embodiment, the molecular scaffold may comprise at least one 3' flanking region, fragment or variant thereof listed in Table 9. As a non-limiting example, the 3' flanking region may be 3F1, 3F2, 3F3, 3F4, or 3F5.

In one embodiment, the molecular scaffold may comprise at least one 3F1 flanking region.

In one embodiment, the molecular scaffold may comprise at least one 3F2 flanking region.

In one embodiment, the molecular scaffold may comprise at least one 3F3 flanking region.

In one embodiment, the molecular scaffold may comprise at least one 3F4 flanking region.

In one embodiment, the molecular scaffold may comprise at least one 3F5 flanking region.

In one embodiment, the molecular scaffold may comprise at least one 5' flanking region, fragment or variant thereof, and at least one loop motif region, fragment or variant thereof, as described in Tables 7 and 8. As a non-limiting example, the 5' flanking region and the loop motif region may be 5F1 and L1, 5F1 and L2, 5F1 and L3, 5F1 and LA, 5F1 and L5. 5F1 and L6, 5F1 and L7, 5F1 and L8, 5F2 and L1, 5F2 and L2, 5F2 and L3, 5F2 and L4, 5F2 and L5, 5F2 and L6, 5F2 and L7, 5F2 and L5, 5F3 and L1, 5F3 and L2, 5F3 and L3, 5F3 and L4, 5F3 and L5, 5F3 and L6, 5F3 and L7, 5F3 and L8, 5F4 and L1, 5F4 and L2, 5F4 and L3, 5F4 and LA, 5F4 and L5, 5F4 and L6, 5F4 and L7, 5F4 and L8, 5F5 and L1, 5F5 and L2, 5F5 and L3, 5F5 and L4, 5F5 and L5, 5F5 and L6, 5F5 and L7, 5F5 and L8, 5F6 and L1, 5F6 and L2, 5F6 and L3, 5F6 and L4, 5F6 and L5, 5F6 and L6, 5F6 and L7, 5F6 and L8, 5F7 and L1, 5F7 and L2, 5F7 and L3, 5F7 and L4, 5F7 and L5, 5F7 and L6, 5F7 and L7, and 5F7 and L8.

In one embodiment, the molecular scaffold may comprise at least one 5F2 flanking region and at least one L1 loop motif region.

In one embodiment, the molecular scaffold may comprise at least one 5F1 flanking region and at least one L4 loop motif region.

In one embodiment, the molecular scaffold may comprise at least one 5F7 flanking region and at least one L8 loop motif region.

In one embodiment, the molecular scaffold may comprise at least one 5F3 flanking region and at least one L4 loop motif region.

In one embodiment, the molecular scaffold may comprise at least one 5F3 flanking region and at least one L5 loop motif region.

In one embodiment, the molecular scaffold may comprise at least one 5F4 flanking region and at least one L4 loop motif region.

In one embodiment, the molecular scaffold may comprise at least one 5F3 flanking region and at least one L7 loop motif region.

In one embodiment, the molecular scaffold may comprise at least one 5F5 flanking region and at least one L4 loop motif region.

In one embodiment, the molecular scaffold may comprise at least one 5F6 flanking region and at least one L4 loop motif region.

In one embodiment, the molecular scaffold may comprise at least one 5F3 flanking region and at least one L6 loop motif region.

In one embodiment, the molecular scaffold may comprise at least one 5F7 flanking region and at least one L4 loop motif region.

In one embodiment, the molecular scaffold may comprise at least one 5F2 flanking region and at least one L2 loop motif region.

In one embodiment, the molecular scaffold may comprise at least one 5F1 flanking region and at least one L1 loop motif region.

In one embodiment, the molecular scaffold may comprise at least one 5F1 flanking region and at least one L2 loop motif region.

In one embodiment, the molecular scaffold may comprise at least one 3' flanking region, fragment or variant thereof, and at least one motif region, fragment or variant thereof, as described in Tables 8 and 9. As a non-limiting example, the 3' flanking region and the loop motif region may be 3F1 and L1, 3F1 and L2, 3F1 and L3, 3F1 and L4, 3F1 and L5, 3F1 and L6, 3F1 and L7, 3F1 and L8, 3F2 and L1, 3F2 and L2, 3F2 and L3, 3F2 and L4, 3F2 and L5, 3F2 and L6, 3F2 and L7, 3F2 and L8, 3F3 and L1, 3F3 and L2, 3F3 and L3, 3F3 and L4A, 3F3 and L5, 3F3 and L6, 3F3 and L7, 3F3 and L8, 3F4 and L1, 3F4 and L2, 3F4 and L3, 3F4 and L4, 3F4 and L5, 3F4 and L6, 3F4 and L7, 3F4 and L8, 3F5 and L1, 3F5 and L2, 3F5 and L3, 3F5 and L4, 3F5 and L5, 3F5 and L6, 3F5 and L7, and 3F5 and L8.

In one embodiment, the molecular scaffold may comprise at least one L1 loop motif region and at least one 3F2 flanking region.

In one embodiment, the molecular scaffold may comprise at least one L4 loop motif region and at least one 3F1 flanking region.

In one embodiment, the molecular scaffold may comprise at least one L8 loop motif region and at least one 3F5 flanking region.

In one embodiment, the molecular scaffold may comprise at least one L5 loop motif region and at least 3F1 flanking region.

In one embodiment, the molecular scaffold may comprise at least one L4 loop motif region and at least one 3F4 flanking region.

In one embodiment, the molecular scaffold may comprise at least one L7 loop motif region and at least one 3F1 flanking region.

In one embodiment, the molecular scaffold may comprise at least one L6 loop motif region and at least one 3F1 flanking region.

In one embodiment, the molecular scaffold may comprise at least one L4 loop motif region and at least one 3F5 flanking region.

In one embodiment, the molecular scaffold may comprise at least one L2 loop motif region and at least one 3F2 flanking region.

In one embodiment, the molecular scaffold may comprise at least one L1 loop motif region and at least one 3F3 flanking region.

In one embodiment, the molecular scaffold may comprise at least one L5 loop motif region and at least one 3F4 flanking region.

In one embodiment, the molecular scaffold may comprise at least one L1 loop motif region and at least one 3F1 flanking region.

In one embodiment, the molecular scaffold may comprise at least one L2 loop motif region and at least one 3F1 flanking region.

In one embodiment, the molecular scaffold may comprise at least one 5' flanking region, fragment or variant thereof, and at least one 3' flanking region, fragment or variant thereof, as described in Tables 7 and 9. As a non-limiting example, the flanking regions may be 5F1 and 3F1, 5F1 and 3F2, 5F1 and 3F3, 5F1 and 3F4, 5F1 and 3F5, 5F2 and 3F1, 5F2 and 3F2, 5F2 and 3F3, 5F2 and 3F4, 5F2 and 3F5, 5F3 and 3F1, 5F3 and 3F2, 5F3 and 3F3, 5F3 and 3F4, 5F3 and 3F5, 5F4 and 3F1, 5F4 and 3F2, 5F4 and 3F3, 5F4 and 3F4, 5F4 and 3F5, 5F5 and 3F1, 5F5 and 3F2, 5F5 and 3F3, 5F5 and 3F4, 5F5 and 3F5, 5F6 and 3F1, 5F6 and 3F2, 5F6 and 3F3, 5F6 and 3F4, 5F6 and 3F5, 5F7 and 3F1, 5F7 and 3F2, 5F7 and 3F3, 5F7 and 3F4, and 5F7 and 3F5.

In one embodiment, the molecular scaffold may comprise at least one 5F2 5' flanking region and at least one 3F2 3' flanking region.

In one embodiment, the molecular scaffold may comprise at least one 5F1 5' flanking region and at least one 3F1 3' flanking region.

In one embodiment, the molecular scaffold may comprise at least one 5F7 5' flanking region and at least one 3F5 3' flanking region.

In one embodiment, the molecular scaffold may comprise at least one 5F3 5' flanking region and at least one 3F1 3' flanking region.

In one embodiment, the molecular scaffold may comprise at least one 5F4 5' flanking region and at least one 3F4 3' flanking region.

In one embodiment, the molecular scaffold may comprise at least one 5F5 5' flanking region and at least one 3F4 3' flanking region.

In one embodiment, the molecular scaffold may comprise at least one 5F6 5' flanking region and at least one 3F1 3' flanking region.

In one embodiment, the molecular scaffold may comprise at least one 5F2 5' flanking region and at least one 3F3 3' flanking region.

In one embodiment, the molecular scaffold may comprise at least one 5F3 5' flanking region and at least one 3F4 3' flanking region.

In one embodiment, the molecular scaffold may comprise at least one 5F1 5' flanking region and at least one 3F2 3' flanking region.

In one embodiment, the molecular scaffold may comprise at least one 5' flanking region, fragment or variant thereof, at least one loop motif region, fragment or variant thereof, and at least one 3' flanking region as described in Tables 7-9. As a non-limiting example, the flanking and loop motif regions may be 5F1, L1 and 3F1; 5F1, L1 and 3F2; 5F1, L1 and 3F3; 5F1, L1 and 3F4; 5F1, L1 and 3F5; 5F2, L1 and 3F1; 5F2, L1 and 3F2; 5F2, L1 and 3F3; 5F2, L1 and 3F4; 5F2, L1 and 3F5; 5F3, L1 and 3F3; 5F3, L1 and 3F2; 5F3, L1 and 3F3; 5F3, L1 and 3F4; 5F3, L1 and 3F5; 5F4, L1 and 3F4; 5F4, L1 and 3F2; 5F4, L1 and 3F3; 5F4, L1 and 3F4; 5F4, L1 and 3F5; 5F5, L1 and 3F1; 5F5, L1 and 3F2; 5F5, L1 and 3F3; 5F5, L1 and 3F4; 5F5, L1 and 3F5; 5F6, L1 and 3F1; 5F6, L1 and 3F2; 5F6, L1 and 3F3; 5F6, L1 and 3F4; 5F6, L1 and 3F5; 5F7, L1 and 3F1; 5F7, L1 and 3F2; 5F7, L1 and 3F3; 5F7, L1 and 3F4; 5F7, L1 and 3F5; 5F1, L2 and 3F1; 5F1, L2 and 3F2; 5F1, L2 and 3F3; 5F1, L2 and 3F4; 5F1, L2 and 3F5; 5F2, L2 and 3F1; 5F2, L2 and 3F2; 5F2, L2 and 3F3; 5F2, L2 and 3F4; 5F2, L2 and 3F5; 5F3, L2 and 3F1; 5F3, L2 and 3F2; 5F3, L2 and 3F3; 5F3, L2 and 3F4; 5F3, L2 and 3F5; 5F4, L2 and 3F1; 5F4, L2 and 3F2; 5F4, L2 and 3F3; 5F4, L2 and 3F4; 5F4, L2 and 3F5; 5F5, L2 and 3F1; 5F5, L2 and 3F2; 5F5, L2 and 3F3; 5F5, L2 and 3F4; 5F5, L2 and 3F5; 5F6, L2 and 3F1; 5F6, L2 and 3F2; 5F6, L2 and 3F3; 5F6, L2 and 3F4; 5F6, L2 and 3F5; 5F7, L2 and 3F1; 5F7, L2 and 3F2; 5F7, L2 and 3F3; 5F7, L2 and 3F4; 5F7, L2 and 3F5; 5F1, L3 and 3F1; 5F1, L3 and 3F2; 5F1, L3 and 3F3; 5F1, L3 and 3F4; 5F1, L3 and 3F5; 5F2, L3 and 3F1; 5F2, L3 and 3F2; 5F2, L3 and 3F3; 5F2, L3 and 3F4; 5F2, L3 and 3F5; 5F3, L3 and 3F1; 5F3, L3 and 3F2; 5F3, L3 and 3F3; 5F3, L3 and 3F4; 5F3, L3 and 3F5; 5F4, L3 and 3F1; 5F4, L3 and 3F2; 5F4, L3 and 3F3; 5F4, L3 and 3F4; 5F4, L3 and 3F5; 5F5, L3 and 3F1; 5F5, L3 and 3F2; 5F5, L3 and 3F3; 5F5, L3 and 3F4; 5F5, L3 and 3F5; 5F6, L3 and 3F1; 5F6, L3 and 3F2; 5F6, L3 and 3F3; 5F6, L3 and 3F4; 5F6, L3 and 3F5; 5F7, L3 and 3F1; 5F7, L3 and 3F2; 5F7, L3 and 3F3; 5F7, L3 and 3F4; 5F7, L3 and 3F5; 5F1, L4 and 3F1; 5F1, L4 and 3F2; 5F1, L4 and 3F3; 5F1, L4 and 3F4; 5F1, L4 and 3F5; 5F2, L4 and 3F1; 5F2, L4 and 3F2; 5F2, L4 and 3F3; 5F2, L4 and 3F4; 5F2, L4 and 3F5; 5F3, L4 and 3F1; 5F3, L4 and 3F2; 5F3, L4 and 3F3; 5F3, L4 and 3F4; 5F3, L4 and 3F5; 5F4, L4 and 3F1; 5F4, L4 and 3F2; 5F4, L4 and 3F3; 5F4, L4 and 3F4; 5F4, L4 and 3F5; 5F5, L4 and 3F1; 5F5, L4 and 3F2; 5F5, L4 and 3F3; 5F5, L4 and 3F4; 5F5, L4 and 3F5; 5F6, L4 and 3F1; 5F6, L4 and 3F2; 5F6, L4 and 3F3; 5F6, L4 and 3F4; 5F6, L4 and 3F5; 5F7, L4 and 3F1; 5F7, L4 and 3F2; 5F7, L4 and 3F3; 5F7, L4 and 3F4; 5F7, L4 and 3F5; 5F1, L5 and 3F1; 5F1, L5 and 3F2; 5F1, L5 and 3F3; 5F1, L5 and 3F4; 5F1, L5 and 3F5; 5F2, L5 and 3F1; 5F2, L5 and 3F2; 5F2, L5 and 3F3; 5F2, L5 and 3F4; 5F2, L5 and 3F5; 5F3, L5 and 3F1; 5F3, L5 and 3F2; 5F3, L5 and 3F3; 5F3, L5 and 3F4; 5F3, L5 and 3F5; 5F4, L5 and 3F1; 5F4, L5 and 3F2; 5F4, L5 and 3F3; 5F4, L5 and 3F4; 5F4, L5 and 3F5; 5F5, L5 and 3F1; 5F5, L5 and 3F2; 5F5, L5 and 3F3; 5F5, L5 and 3F4; 5F5, L5 and 3F5; 5F6, L5 and 3F1; 5F6, L5 and 3F2; 5F6, L5 and 3F3; 5F6, L5 and 3F4; 5F6, L5 and 3F5; 5F7, L5 and 3F1; 5F7, L5 and 3F2; 5F7, L5 and 3F3; 5F7, L5 and 3F4; 5F7, L5 and 3F5; 5F1, L6 and 3F1; 5F1, L6 and 3F2; 5F1, L6 and 3F3; 5F1, L6 and 3F4; 5F1, L6 and 3F5; 5F2, L6 and 3F1; 5F2, L6 and 3F2; 5F2, L6 and 3F3; 5F2, L6 and 3F4; 5F2, L6 and 3F5; 5F3, L6 and 3F1; 5F3, L6 and 3F2; 5F3, L6 and 3F3; 5F3, L6 and 3F4; 5F3, L6 and 3F5; 5F4, L6 and 3F1; 5F4, L6 and 3F2; 5F4, L6 and 3F3; 5F4, L6 and 3F4; 5F4, L6 and 3F5; 5F5, L6 and 3F1; 5F5, L6 and 3F2; 5F5, L6 and 3F3; 5F5, L6 and 3F4; 5F5, L6 and 3F5; 5F6, L6 and 3F1; 5F6, L6 and 3F2; 5F6, L6 and 3F3; 5F6, L6 and 3F4; 5F6, L6 and 3F5; 5F7, L6 and 3F1; 5F7, L6 and 3F2; 5F7, L6 and 3F3; 5F7, L6 and 3F4; 5F7, L6 and 3F5; 5F1, L7 and 3F3; 5F1, L7 and 3F2; 5F1, L7 and 3F3; 5F1, L7 and 3F4; 5F1, L7 and 3F5; 5F2, L7 and 3F1; 5F2, L7 and 3F2; 5F2, L7 and 3F3; 5F2, L7 and 3F4; 5F2, L7 and 3F5; 5F3, L7 and 3F1; 5F3, L7 and 3F2; 5F3, L7 and 3F3; 5F3, L7 and 3F4; 5F3, L7 and 3F5; 5F4, L7 and 3F1; 5F4, L7 and 3F2; 5F4, L7 and 3F3; 5F4, L7 and 3F4; 5F4, L7 and 3F5; 5F5, L7 and 3F1; 5F5, L7 and 3F2; 5F5, L7 and 3F3; 5F5, L7 and 3F4; 5F5, L7 and 3F5; 5F6, L7 and 3F1; 5F6, L7 and 3F2; 5F6, L7 and 3F3; 5F6, L7 and 3F4; 5F6, L7 and 3F5; 5F7, L7 and 3F1; 5F7, L7 and 3F2; 5F7, L7 and 3F3; 5F7, L7 and 3F4; 5F7, L7 and 3F5; 5F1, L8 and 3F1; 5F1, L8 and 3F2; 5F1, L8 and 3F3; 5F1, L8 and 3F4; 5F1, L8 and 3F5; 5F2, L8 and 3F1; 5F2, L8 and 3F2; 5F2, L8 and 3F3; 5F2, L8 and 3F4; 5F2, L8 and 3F5; 5F3, L8 and 3F1; 5F3, L8 and 3F2; 5F3, L8 and 3F3; 5F3, L8 and 3F4; 5F3, L8 and 3F5; 5F4, L8 and 3F1; 5F4, L8 and 3F2; 5F4, L8 and 3F3; 5F4, L8 and 3F4; 5F4, L8 and 3F5; 5F5, L8 and 3F1; 5F5, L8 and 3F2; 5F5, L8 and 3F3; 5F5, L8 and 3F4; 5F5, L8 and 3F5; 5F6, L8 and 3F1; 5F6, L8 and 3F2; 5F6, L8 and 3F3; 5F6, L8 and 3F4; 5F6, L8 and 3F5; 5F7, L8 and 3F1; 5F7, L8 and 3F2; 5F7, L8 and 3F3; 5F7, L8 and 3F4 and 5F7, L8 and 3F5.

In one embodiment, the molecular scaffold may comprise at least one 5F2 5' flanking region, at least one L1 loop motif region, and at least one 3F2 3' flanking region.

In one embodiment, the molecular scaffold may comprise at least one 5F1 5' flanking region, at least one L4 loop motif region, and at least one 3F1 3' flanking region.

In one embodiment, the molecular scaffold may comprise at least one 5F7 5' flanking region, at least one L8 loop motif region, and at least one 3F5 3' flanking region.

In one embodiment, the molecular scaffold may comprise at least one 5F3 5' flanking region, at least one L4 loop motif region, and at least one 3F1 3' flanking region.

In one embodiment, the molecular scaffold may comprise at least one 5F3 5' flanking region, at least one L5 loop motif region, and at least one 3F1 3' flanking region.

In one embodiment, the molecular scaffold may comprise at least one 5F4 5' flanking region, at least one L4 loop motif region, and at least one 3F4 3' flanking region.

In one embodiment, the molecular scaffold may comprise at least one 5F3 5' flanking region, at least one L7 loop motif region, and at least one 3F1 3' flanking region.

In one embodiment, the molecular scaffold may comprise at least one 5F5 5' flanking region, at least one L4 loop motif region, and at least one 3F4 3' flanking region.

In one embodiment, the molecular scaffold may comprise at least one 5F6 5' flanking region, at least one L4 loop motif region, and at least one 3F1 3' flanking region.

In one embodiment, the molecular scaffold may comprise at least one 5F3 5' flanking region, at least one L6 loop motif region, and at least one 3F1 3' flanking region.

In one embodiment, the molecular scaffold may comprise at least one 5F7 5' flanking region, at least one L4 loop motif region, and at least one 3F5 3' flanking region.

In one embodiment, the molecular scaffold may comprise at least one 5F2 5' flanking region, at least one L2 loop motif region, and at least one 3F2 3' flanking region.

In one embodiment, the molecular scaffold may comprise at least one 5F2 5' flanking region, at least one L1 loop motif region, and at least one 3F3 3' flanking region.

In one embodiment, the molecular scaffold may comprise at least one 5F3 5' flanking region, at least one L5 loop motif region, and at least one 3F4 3' flanking region.

In one embodiment, the molecular scaffold may comprise at least one 5F1 5' flanking region, at least one L1 loop motif region, and at least one 3F1 3' flanking region.

In one embodiment, the molecular scaffold may comprise at least one 5F1 5' flanking region, at least one L2 loop motif region, and at least one 3F1 3' flanking region.

In one embodiment, the molecular scaffold may comprise at least one 5F1 5' flanking region, at least one L1 loop motif region, and at least one 3F2 3' flanking region.

In one embodiment, the molecular scaffold may comprise at least one 5F2 5' flanking region, at least one L3 loop motif region, and at least one 3F3 3' flanking region.

In one embodiment, the molecular scaffold may be a natural pri-miRNA scaffold. As a non-limiting example, the molecular scaffold may be a scaffold derived from the human miR155 scaffold.

In one embodiment, the molecular scaffold may comprise one or more linkers known in the art. The linkers may separate regions or one molecular scaffold from another. As a non-limiting example, the molecular scaffold may be polycistronic.

Modulatory Polynucleotide Comprising Molecular Scaffold and siRNA Molecule

In one embodiment, the modulatory polynucleotide may comprise 5' and 3' flanking regions, loop motif region, and nucleic acid sequences encoding sense sequence and antisense sequence as described in Tables 10 and 11. In Tables 10 and 11, the DNA sequence identifier for the passenger and guide strands are described as well as the 5' and 3' Flanking Regions and the Loop region (also referred to as the linker region). In Tables 10 and 11, the "miR" component of the name of the sequence does not necessarily correspond to the sequence numbering of miRNA genes (e.g., VOYHTmiR-102 is the name of the sequence and does not necessarily mean that miR-102 is part of the sequence).

TABLE 10

Modulatory Polynucleotide Sequence Region (5' to 3')

| Modulatory Polynucleotide Construct Name | 5' Flanking to 3' Flanking SEQ ID NO | 5' Flanking SEQ ID NO | Passenger SEQ ID NO | Loop SEQ ID NO | Guide SEQ ID NO | 3' Flanking SEQ ID NO |
|---|---|---|---|---|---|---|
| VOYHTmiR-102.214 | 1183 | 1161 | 1296 | 1168 | 1337 | 1178 |
| VOYHTmiR-104.214 | 1184 | 1161 | 1303 | 1168 | 1337 | 1178 |
| VOYHTmiR-109.214 | 1185 | 1161 | 1310 | 1169 | 1337 | 1178 |
| VOYHTmiR-114.214 | 1186 | 1161 | 1317 | 1168 | 1337 | 1179 |
| VOYHTmiR-116.214 | 1187 | 1161 | 1310 | 1168 | 1337 | 1179 |
| VOYHTmiR-127.214 | 1188 | 1162 | 1310 | 1170 | 1334 | 1180 |
| VOYHTmiR-102.218 | 1189 | 1161 | 1297 | 1168 | 1338 | 1178 |
| VOYHTmiR-104.218 | 1190 | 1161 | 1304 | 1168 | 1338 | 1178 |
| VOYHTmiR-109.218 | 1191 | 1161 | 1311 | 1169 | 1338 | 1178 |
| VOYHTmiR-114.218 | 1192 | 1161 | 1318 | 1168 | 1338 | 1179 |
| VOYHTmiR-116.218 | 1193 | 1161 | 1311 | 1168 | 1338 | 1179 |
| VOYHTmiR-127.218 | 1194 | 1162 | 1311 | 1170 | 1338 | 1180 |
| VOYHTmiR-102.219.o | 1195 | 1161 | 1280 | 1168 | 1333 | 1178 |
| VOYHTmiR-104.219.o | 1196 | 1161 | 1283 | 1168 | 1333 | 1178 |
| VOYHTmiR-109.219.o | 1197 | 1161 | 1280 | 1169 | 1333 | 1178 |
| VOYHTmiR-114.219 | 1198 | 1161 | 1286 | 1168 | 1333 | 1179 |
| VOYHTmiR-116.219.o | 1199 | 1161 | 1289 | 1168 | 1333 | 1179 |
| VOYHTmiR-127.219.o | 1200 | 1162 | 1280 | 1170 | 1333 | 1180 |
| VOYHTmiR-102.219.n | 1201 | 1161 | 1292 | 1168 | 1333 | 1178 |
| VOYHTmiR-104.219.n | 1202 | 1161 | 1293 | 1168 | 1333 | 1178 |
| VOYHTmiR-109.219.n | 1203 | 1161 | 1292 | 1169 | 1333 | 1178 |
| VOYHTmiR-116.219.n | 1204 | 1161 | 1294 | 1168 | 1333 | 1179 |
| VOYHTmiR-127.219.n | 1205 | 1162 | 1292 | 1170 | 1333 | 1180 |
| VOYHTmiR-102.257 | 1206 | 1161 | 1298 | 1168 | 1339 | 1178 |
| VOYHTmiR-104.257 | 1207 | 1161 | 1305 | 1168 | 1339 | 1178 |
| VOYHTmiR-109.257 | 1208 | 1161 | 1312 | 1169 | 1339 | 1178 |
| VOYHTmiR-114.257 | 1209 | 1161 | 1319 | 1168 | 1339 | 1179 |
| VOYHTmiR-116.257 | 1210 | 1161 | 1312 | 1168 | 1339 | 1179 |
| VOYHTmiR-127.257 | 1211 | 1162 | 1312 | 1170 | 1339 | 1180 |
| VOYHTmiR-102.894 | 1212 | 1161 | 1281 | 1168 | 1334 | 1178 |
| VOYHTmiR-104.894 | 1213 | 1161 | 1284 | 1168 | 1334 | 1178 |
| VOYHTmiR-109.894 | 1214 | 1161 | 1281 | 1169 | 1334 | 1178 |
| VOYHTmiR-114.894 | 1215 | 1161 | 1287 | 1168 | 1334 | 1179 |
| VOYHTmiR-116.894 | 1216 | 1161 | 1290 | 1168 | 1334 | 1179 |
| VOYHTmiR-127,894 | 1217 | 1162 | 1281 | 1170 | 1334 | 1180 |

TABLE 10-continued

| Modulatory Polynucleotide Sequence Region (5' to 3') | | | | | |
|---|---|---|---|---|---|
| Modulatory Polynucleotide Construct Name | 5' Flanking to 3' Flanking SEQ ID NO | 5' Flanking SEQ ID NO | Passenger SEQ ID NO | Loop SEQ ID NO | Guide SEQ ID NO | 3' Flanking SEQ ID NO |
| VOYHTmiR-102.907 | 1218 | 1161 | 1301 | 1168 | 1342 | 1178 |
| VOYHTmiR-104.907 | 1219 | 1161 | 1308 | 1168 | 1342 | 1178 |
| VOYHTmiR-109.907 | 1220 | 1161 | 1315 | 1169 | 1342 | 1178 |
| VOYHTmiR-114.907 | 1221 | 1161 | 1322 | 1168 | 1342 | 1179 |
| VOYHTmiR-116.907 | 1222 | 1161 | 1315 | 1168 | 1342 | 1179 |
| VOYHTmiR-127.907 | 1223 | 1162 | 1315 | 1170 | 1342 | 1180 |
| VOYHTmiR-102.372 | 1224 | 1161 | 1299 | 1168 | 1340 | 1178 |
| VOYHTmiR-104.372 | 1225 | 1161 | 1306 | 1168 | 1340 | 1178 |
| VOYHTmiR-109.372 | 1226 | 1161 | 1313 | 1169 | 1340 | 1178 |
| VOYHTmiR-114.372 | 1227 | 1161 | 1320 | 1168 | 1340 | 1179 |
| VOYHTmiR-116.372 | 1228 | 1161 | 1313 | 1168 | 1340 | 1179 |
| VOYHTmiR-127.372 | 1229 | 1162 | 1313 | 1170 | 1340 | 1180 |
| VOYHTmiR-102.425 | 1230 | 1161 | 1300 | 1168 | 1341 | 1178 |
| VOYHTmiR-104.425 | 1231 | 1161 | 1307 | 1168 | 1341 | 1178 |
| VOYHTmiR-109.425 | 1232 | 1161 | 1314 | 1169 | 1341 | 1178 |
| VOYHTmiR-114.425 | 1233 | 1161 | 1321 | 1168 | 1341 | 1179 |
| VOYHTmiR-116.425 | 1234 | 1161 | 1314 | 1168 | 1341 | 1179 |
| VOYHTmiR-127.425 | 1235 | 1162 | 1314 | 1170 | 1341 | 1180 |
| VOYHTmiR-102.032 | 1236 | 1161 | 1324 | 1168 | 1344 | 1178 |
| VOYHTmiR-104.032 | 1237 | 1161 | 1326 | 1168 | 1344 | 1178 |
| VOYHTmiR-109.032 | 1238 | 1161 | 1328 | 1169 | 1344 | 1178 |
| VOYHTmiR-114.032 | 1239 | 1161 | 1330 | 1168 | 1344 | 1179 |
| VOYHTmiR-116.032 | 1240 | 1161 | 1328 | 1168 | 1344 | 1179 |
| VOYHTmiR-127.032 | 1241 | 1162 | 1328 | 1170 | 1344 | 1180 |
| VOYHTmiR-102.020 | 1242 | 1161 | 1323 | 1168 | 1343 | 1178 |
| VOYHTmiR-104.020 | 1243 | 1161 | 1325 | 1168 | 1343 | 1178 |
| VOYHTmiR-109.020 | 1244 | 1161 | 1327 | 1169 | 1343 | 1178 |
| VOYHTmiR-114.020 | 1245 | 1161 | 1329 | 1168 | 1343 | 1179 |
| VOYHTmiR-116.020 | 1246 | 1161 | 1327 | 1168 | 1343 | 1179 |
| VOYHTmiR-127.020 | 1247 | 1162 | 1327 | 1170 | 1343 | 1180 |
| VOYHTmiR-102.016 | 1248 | 1161 | 1295 | 1168 | 1336 | 1178 |
| VOYHTmiR-104.016 | 1249 | 1161 | 1302 | 1168 | 1336 | 1178 |
| VOYHTmiR-109.016 | 1250 | 1161 | 1309 | 1169 | 1336 | 1178 |
| VOYHTmiR-114.016 | 1251 | 1161 | 1316 | 1168 | 1336 | 1179 |
| VOYHTmiR-116.016 | 1252 | 1161 | 1309 | 1168 | 1336 | 1179 |
| VOYHTmiR-127.016 | 1253 | 1162 | 1309 | 1170 | 1336 | 1180 |
| VOYHTmiR-102.579 | 1254 | 1161 | 1282 | 1168 | 1335 | 1178 |
| VOYHTmiR-104.579 | 1255 | 1161 | 1285 | 1168 | 1335 | 1178 |
| VOYHTmiR-109.579 | 1256 | 1161 | 1282 | 1169 | 1335 | 1178 |
| VOYHTmiR-114.579 | 1257 | 1161 | 1288 | 1168 | 1335 | 1179 |
| VOYHTmiR-116.579 | 1258 | 1161 | 1291 | 1168 | 1335 | 1179 |
| VOYHTmiR-127.579 | 1259 | 1162 | 1282 | 1170 | 1335 | 1180 |
| VOYHTmiR-104.579.1 | 1260 | 1161 | 1331 | 1171 | 1335 | 1178 |
| VOYHTmiR-104.579.2 | 1261 | 1163 | 1331 | 1171 | 1335 | 1178 |
| VOYHTmiR-104.579.3 | 1262 | 1163 | 1331 | 1172 | 1335 | 1178 |
| VOYHTmiR-104.579.4 | 1263 | 1164 | 1331 | 1171 | 1335 | 1181 |
| VOYHTmiR-104.579.6 | 1264 | 1165 | 1331 | 1171 | 1335 | 1181 |
| VOYHTmiR-104.579.7 | 1265 | 1166 | 1331 | 1171 | 1345 | 1178 |
| VOYHTmiR-104.579.8 | 1266 | 1163 | 1337 | 1173 | 1335 | 1178 |
| VOYHTmiR-104.579.9 | 1267 | 1167 | 1331 | 1171 | 1335 | 1182 |
| VOYHTmiR-102.020 | 1268 | 1161 | 1323 | 1168 | 1343 | 1178 |
| VOYHTmiR-102.032 | 1269 | 1161 | 1324 | 1168 | 1344 | 1178 |
| VOYHTmiR-104.020 | 1270 | 1161 | 1325 | 1168 | 1343 | 1178 |
| VOYHTmiR-104.032 | 1271 | 1161 | 1326 | 1168 | 1344 | 1178 |
| VOYHTmiR-109.020 | 1272 | 1161 | 1327 | 1169 | 1343 | 1178 |
| VOYHTmiR-109.032 | 1273 | 1161 | 1328 | 1169 | 1344 | 1178 |
| VOYHTmiR-114.020 | 1274 | 1161 | 1329 | 1168 | 1343 | 1179 |
| VOYHTmiR-114.032 | 1275 | 1161 | 1330 | 1168 | 1344 | 1179 |
| VOYHTmiR-116.020 | 1276 | 1161 | 1327 | 1168 | 1343 | 1179 |
| VOYHTmiR-116.032 | 1277 | 1161 | 1328 | 1168 | 1344 | 1179 |
| VOYHTmiR-127.020 | 1278 | 1162 | 1327 | 1170 | 1343 | 1180 |
| VOYHTmiR-127.032 | 1279 | 1162 | 1328 | 1170 | 1344 | 1180 |

TABLE 11

Modulatory Polynucleotide Sequence Region (5' to 3')

| Name | 5' Flanking to 3' Flanking SEQ ID NO | 5' Flanking SEQ ID NO | Guide SEQ ID NO | Loop SEQ ID NO | Passenger SEQ ID NO | 3' Flanking SEQ ID NO |
|---|---|---|---|---|---|---|
| VOYHTmiR-104.579.5 | 1346 | 1163 | 1350 | 1174 | 1348 | 1178 |
| VOYHTmiR-104.579.10 | 1347 | 1167 | 1351 | 1175 | 1349 | 1182 |

AAV Particles Comprising Modulatory Polynucleotides

In one embodiment, the AAV particle comprises a viral genome with a payload region comprising a modulatory polynucleotide sequences. In such an embodiment, a viral genome encoding more than one polypeptide may be replicated and packaged into a viral particle. A target cell transduced with a viral particle comprising a modulatory polynucleotide may express the encoded sense and/or antisense sequences in a single cell.

In some embodiments, the AAV particles are useful in the field of medicine for the treatment, prophylaxis, palliation or amelioration of neurological diseases and/or disorders.

Non-limiting examples of ITR to ITR sequences of AAV particles comprising a viral genome with a payload region comprising a modulatory polynucleotide sequence are described in Table 12.

TABLE 12

ITR to ITR Sequences of AAV Particles comprising Modulatory Polynucleotides

| ITR to ITR Construct Name | ITR to ITR SEQ ID NO | Modulatory Polynucleotide SEQ ID NO |
|---|---|---|
| VOYHT1 | 1352 | 1262 |
| VOYHT2 | 1353 | 1262 |
| VOYHT3 | 1354 | 1250 |
| VOYHT4 | 1355 | 1347 |
| VOYHT5 | 1356 | 1262 |
| VOYHT6 | 1357 | 1262 |
| VOYHT7 | 1358 | 1250 |
| VOYHT8 | 1359 | 1347 |
| VOYHT9 | 1360 | 1262 |
| VOYHT10 | 1361 | 1262 |
| VOYHT11 | 1362 | 1250 |
| VOYHT12 | 1363 | 1347 |
| VOYHT13 | 1364 | 1262 |
| VOYHT14 | 1365 | 1249 |
| VOYHT15 | 1366 | 1259 |
| VOYHT16 | 1367 | 1249 |
| VOYHT17 | 1368 | 1262 |
| VOYHT18 | 1369 | 1262 |
| VOYHT19 | 1370 | 1262 |
| VOYHT20 | 1371 | 1262 |
| VOYHT21 | 1372 | 1262 |
| VOYHT22 | 1373 | 1262 |
| VOYHT23 | 1374 | 1262 |
| VOYHT24 | 1375 | 1262 |
| VOYHT25 | 1376 | 1249 |
| VOYHT26 | 1377 | 1262 |
| VOYHT27 | 1378 | 1259 |
| VOYHT28 | 1379 | 1249 |
| VOYHT35 | 1388 | 1255 |
| VOYHT36 | 1426 | 1248 |
| VOYHT37 | 1427 | 1231 |
| VOYHT38 | 1428 | 1219 |
| VOYHT39 | 1429 | 1207 |
| VOYHT40 | 1430 | 1250 |
| VOYHT41 | 1431 | 1251 |
| VOYHT42 | 1432 | 1252 |
| VOYHT43 | 1433 | 1253 |
| VOYHT44 | 1434 | 1194 |
| VOYHT45 | 1435 | 1223 |
| VOYHT46 | 1436 | 1211 |
| VOYHT47 | 1437 | 1262 |
| VOYHT48 | 1438 | 1347 |

In one embodiment, the AAV particle comprises a viral genome which comprises a sequence which has a percent identity to any of SEQ ID NOs: 1352-1379, 1388, and 1426-1438. The viral genome may have 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 99% or 100% identity to any of SEQ ID NOs: 1352-1379, 1388, and 1426-1438. The viral genome may have 1-10%, 10-20%, 30-40%, 50-60%, 50-70%, 50-80%, 50-90%, 50-99%, 50-100%, 60-70%, 60-80%, 60-90%, 60-99%, 60-100%, 70-80%, 70-90%, 70-99%, 70-100%, 80-85%, 80-90%, 80-95%, 80-99%, 80-100%, 90-95%, 90-99%, or 90-100% to any of SEQ ID NOs: 1352-1379, 1388, and 1426-1438. As a non-limiting example, the viral genome comprises a sequence which as 80% identity to any of SEQ ID NO: 1352-1379, 1388, and 1426-1438. As another non-limiting example, the viral genome comprises a sequence which as 85% identity to any of SEQ ID NO: 1352-1379, 1388, and 1426-1438. As another non-limiting example, the viral genome comprises a sequence which as 90% identity to any of SEQ ID NO: 1352-1379, 1388, and 1426-1438. As another non-limiting example, the viral genome comprises a sequence which as 95% identity to any of SEQ ID NO: 1352-1379, 1388, and 1426-1438. As another non-limiting example, the viral genome comprises a sequence which as 99% identity to any of SEQ ID NO: 1352-1379, 1388, and 1426-1438.

In one embodiment, the AAV particles comprising modulatory polynucleotide sequence which comprises a nucleic acid sequence encoding at least one siRNA molecule may be introduced into mammalian cells.

Where the AAV particle payload region comprises a modulatory polynucleotide, the modulatory polynucleotide may comprise sense and/or antisense sequences to knock down a target gene. The AAV viral genomes encoding modulatory polynucleotides described herein may be useful in the fields of human disease, viruses, infections veterinary applications and a variety of in vivo and in vitro settings.

In one embodiment, the AAV particle viral genome may comprise at least one inverted terminal repeat (ITR) region. The ITR region(s) may, independently, have a length such as, but not limited to, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, and 175 nucleotides. The length of the ITR region for the viral genome may be 75-80, 75-85, 75-100, 80-85, 80-90, 80-105, 85-90, 85-95, 85-110, 90-95, 90-100, 90-115, 95-100, 95-105, 95-120, 100-105, 100-110, 100-125, 105-

110, 105-115, 105-130, 110-115, 110-120, 110-135, 115-120, 115-125, 115-140, 120-125, 120-130, 120-145, 125-130, 125-135, 125-150, 130-135, 130-140, 130-155, 135-140, 135-145, 135-160, 140-145, 140-150, 140-165, 145-150, 145-155, 145-170, 150-155, 150-160, 150-175, 155-160, 155-165, 160-165, 160-170, 165-170, 165-175, and 170-175 nucleotides. As a non-limiting example, the viral genome comprises an ITR that is about 105 nucleotides in length. As a non-limiting example, the viral genome comprises an ITR that is about 141 nucleotides in length. As a non-limiting example, the viral genome comprises an ITR that is about 130 nucleotides in length.

In one embodiment, the AAV particle viral genome may comprises two inverted terminal repeat (ITR) regions. Each of the ITR regions may independently have a length such as, but not limited to, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, and 175 nucleotides. The length of the ITR regions for the viral genome may be 75-80, 75-85, 75-100, 80-85, 80-90, 80-105, 85-90, 85-95, 85-110, 90-95, 90-100, 90-115, 95-100, 95-105, 95-120, 100-105, 100-110, 100-125, 105-110, 105-115, 105-130, 110-115, 110-120, 110-135, 115-120, 115-125, 115-140, 120-125, 120-130, 120-145, 125-130, 125-135, 125-150, 130-135, 130-140, 130-155, 135-140, 135-145, 135-160, 140-145, 140-150, 140-165, 145-150, 145-155, 145-170, 150-155, 150-160, 150-175, 155-160, 155-165, 160-165, 160-170, 165-170, 165-175, and 170-175 nucleotides. As a non-limiting example, the viral genome comprises an ITR that is about 105 nucleotides in length and 141 nucleotides in length. As a non-limiting example, the viral genome comprises an ITR that is about 105 nucleotides in length and 130 nucleotides in length. As a non-limiting example, the viral genome comprises an ITR that is about 130 nucleotides in length and 141 nucleotides in length.

In one embodiment, the AAV particle viral genome may comprise at least one sequence region as described in Tables 13-20. The regions may be located before or after any of the other sequence regions described herein.

In one embodiment, the AAV particle viral genome comprises at least one inverted terminal repeat (ITR) sequence region. Non-limiting examples of ITR sequence regions are described in Table 13.

TABLE 13

Inverted Terminal Repeat (ITR) Sequence Regions

| Sequence Region Name | SEQ ID NO |
|---|---|
| ITR1 | 1380 |
| ITR2 | 1381 |
| ITR3 | 1382 |
| ITR4 | 1383 |

In one embodiment, the AAV particle viral genome comprises two ITR sequence regions. In one embodiment, the ITR sequence regions are the ITR1 sequence region and the ITR3 sequence region. In one embodiment, the ITR sequence regions are the ITR1 sequence region and the ITR4 sequence region. In one embodiment, the ITR sequence regions are the ITR2 sequence region and the ITR3 sequence region. In one embodiment, the ITR sequence regions are the ITR2 sequence region and the ITR4 sequence region.

In one embodiment, the AAV particle viral genome may comprise at least one multiple cloning site (MCS) sequence region. The MCS region(s) may, independently, have a length such as, but not limited to, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, and 150 nucleotides. The length of the MCS region for the viral genome may be 2-10, 5-10, 5-15, 10-20, 10-30, 10-40, 15-20, 15-25, 20-30, 20-40, 20-50, 25-30, 25-35, 30-40, 30-50, 30-60, 35-40, 35-45, 40-50, 40-60, 40-70, 45-50, 45-55, 50-60, 50-70, 50-80, 55-60, 55-65, 60-70, 60-80, 60-90, 65-70, 65-75, 70-80, 70-90, 70-100, 75-80, 75-85, 80-90, 80-100, 80-110, 85-90, 85-95, 90-100, 90-110, 90-120, 95-100, 95-105, 100-110, 100-120, 100-130, 105-110, 105-115, 110-120, 110-130, 110-140, 115-120, 115-125, 120-130, 120-140, 120-150, 125-130, 125-135, 130-140, 130-150, 135-140, 135-145, 140-150, and 145-150 nucleotides. As a non-limiting example, the viral genome comprises a MCS region that is about 5 nucleotides in length. As a non-limiting example, the viral genome comprises a MCS region that is about 10 nucleotides in length. As a non-limiting example, the viral genome comprises a MCS region that is about 14 nucleotides in length. As a non-limiting example, the viral genome comprises a MCS region that is about 18 nucleotides in length. As a non-limiting example, the viral genome comprises a MCS region that is about 73 nucleotides in length. As a non-limiting example, the viral genome comprises a MCS region that is about 121 nucleotides in length.

In one embodiment, the AAV particle viral genome comprises at least one multiple cloning site (MCS) sequence regions. Non-limiting examples of MCS sequence regions are described in Table 14.

TABLE 14

Multiple Cloning Site (MCS) Sequence Regions

| Sequence Region Name | SEQ ID NO or Sequence |
|---|---|
| MCS1 | 1384 |
| MCS2 | 1385 |
| MCS3 | 1386 |
| MCS4 | 1387 |
| MCS5 | TCGAG |
| MCS6 | 1389 |

In one embodiment, the AAV particle vi genome comprises one CS sequence region. In one embodiment, the MCS sequence region is the MCS1 sequence region. In one embodiment, the MCS sequence region is the MCS2 sequence region. In one embodiment, the MCS sequence region is the MCS3 sequence region. In one embodiment, the MCS sequence region is the MCS4 sequence region. In one embodiment, the MCS sequence region is the MCS5 sequence region. In one embodiment, the MCS sequence region is the MCS6 sequence region.

In one embodiment, the AAV particle viral genome comprises two MCS sequence regions. In one embodiment, the two MCS sequence regions are the MCS1 sequence region and the MCS2 sequence region. In one embodiment, the two MCS sequence regions are the MCS1 sequence region and the MCS3 sequence region. In one embodiment, the two MCS sequence regions are the MCS1 sequence region and the MCS4 sequence region. In one embodiment, the two MCS sequence regions are the MCS1 sequence region and the MCS5 sequence region. In one embodiment, the two MCS sequence regions are the MCS1 sequence region and the MCS6 sequence region. In one embodiment, the two MCS sequence regions are the MCS2 sequence region and the MCS3 sequence region. In one embodiment, the two MCS sequence regions are the MCS2 sequence region and the MCS4 sequence region. In one embodiment, the two MCS sequence regions are the MCS2 sequence region and the MCS5 sequence region. In one embodiment, the two MCS sequence regions are the MCS2 sequence region and the MCS6 sequence region. In one embodiment, the two MCS sequence regions are the MCS3 sequence region and the MCS4 sequence region. In one embodiment, the two MCS sequence regions are the MCS3 sequence region and the MCS5 sequence region. In one embodiment, the two MCS sequence regions are the MCS3 sequence region and the MCS6 sequence region. In one embodiment, the two MCS sequence regions are the MCS4 sequence region and the MCS5 sequence region. In one embodiment, the two MCS sequence regions are the MCS4 sequence region and the MCS6 sequence region. In one embodiment, the two MCS sequence regions are the MCS5 sequence region and the MCS6 sequence region.

In one embodiment, the AAV particle viral genome comprises two or more MCS sequence regions.

In one embodiment, the AAV particle viral genome comprises three MCS sequence regions. In one embodiment, the three MCS sequence regions are the MCS1 sequence region, the MCS2 sequence region, and the MCS3 sequence region. In one embodiment, the three MCS sequence regions are the MCS1 sequence region, the MCS2 sequence region, and the MCS4 sequence region. In one embodiment, the three MCS sequence regions are the MCS1 sequence region, the MCS2 sequence region, and the MCS5 sequence region. In one embodiment, the three MCS sequence regions are the MCS1 sequence region, the MCS2 sequence region, and the MCS6 sequence region. In one embodiment, the three MCS sequence regions are the MCS1 sequence region, the MCS3 sequence region, and the MCS4 sequence region. In one embodiment, the three MCS sequence regions are the MCS1 sequence region, the MCS3 sequence region, and the MCS5 sequence region. In one embodiment, the three MCS sequence regions are the MCS1 sequence region, the MCS3 sequence region, and the MCS6 sequence region. In one embodiment, the three MCS sequence regions are the MCS1 sequence region, the MCS4 sequence region, and the MCS5 sequence region. In one embodiment, the three MCS sequence regions are the MCS1 sequence region, the MCS4 sequence region, and the MCS6 sequence region. In one embodiment, the three MCS sequence regions are the MCS1 sequence region, the MCS5 sequence region, and the MCS6 sequence region. In one embodiment, the three MCS sequence regions are the MCS2 sequence region, the MCS3 sequence region, and the MCS4 sequence region. In one embodiment, the three MCS sequence regions are the MCS2 sequence region, the MCS3 sequence region, and the MCS5 sequence region. In one embodiment, the three MCS sequence regions are the MCS2 sequence region, the MCS3 sequence region, and the MCS6 sequence region. In one embodiment, the three MCS sequence regions are the MCS2 sequence region, the MCS4 sequence region, and the MCS5 sequence region. In one embodiment, the three MCS sequence regions are the MCS2 sequence region, the MCS4 sequence region, and the MCS6 sequence region. In one embodiment, the three MCS sequence regions are the MCS2 sequence region, the MCS5 sequence region, and the MCS6 sequence region. In one embodiment, the three MCS sequence regions are the MCS3 sequence region, the MCS4 sequence region, and the MCS5 sequence region. In one embodiment, the three MCS sequence regions are the MCS3 sequence region, the MCS4 sequence region, and the MCS6 sequence region. In one embodiment, the three MCS sequence regions are the MCS3 sequence region, the MCS5 sequence region, and the MCS6 sequence region. In one embodiment, the three MCS sequence regions are the MCS4 sequence region, the MCS5 sequence region, and the MCS6 sequence region.

In one embodiment, the AAV particle viral genome may comprise at least one multiple filler sequence region. The filler region(s) may, independently, have a length such as, but not limited to, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, 1037, 1038, 1039, 1040, 1041, 1042, 1043, 1044, 1045, 1046, 1047, 1048, 1049, 1050, 1051, 1052, 1053, 1054, 1055, 1056, 1057, 1058, 1059, 1060, 1061, 1062, 1063, 1064, 1065, 1066, 1067, 1068, 1069, 1070, 1071, 1072, 1073, 1074, 1075, 1076, 1077, 1078, 1079, 1080, 1081, 1082, 1083, 1084, 1085, 1086, 1087, 1088, 1089, 1090, 1091, 1092, 1093, 1094, 1095, 1096, 1097, 1098, 1099, 1100, 1101, 1102, 1103, 1104, 1105, 1106, 1107, 1108, 1109, 1110, 1111, 1112, 1113, 1114, 1115, 1116, 1117, 1118, 1119, 1120, 1121, 1122, 1123, 1124, 1125, 1126, 1127, 1128, 1129, 1130, 1131, 1132, 1133, 1134, 1135, 1136, 1137, 1138, 1139, 1140, 1141, 1142, 1143, 1144, 1145, 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1178, 1179, 1180, 1181, 1182, 1183, 1184, 1185, 1186, 1187, 1188, 1189, 1190, 1191, 1192, 1193, 1194, 1195, 1196, 1197, 1198, 1199, 1200, 1201, 1202, 1203, 1204, 1205, 1206, 1207, 1208, 1209, 1210, 1211, 1212, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1246, 1247, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, 1541, 1542, 1543, 1544, 1545, 1546, 1547, 1548, 1549, 1550, 1551, 1552, 1553, 1554, 1555, 1556, 1557, 1558, 1559, 1560, 1561, 1562, 1563, 1564, 1565, 1566, 1567, 1568, 1569, 1570, 1571, 1572, 1573, 1574, 1575, 1576, 1577, 1578, 1579, 1580, 1581, 1582, 1583, 1584, 1585, 1586, 1587, 1588, 1589, 1590, 1591, 1592, 1593, 1594, 1595, 1596, 1597, 1598, 1599, 1600, 1601, 1602, 1603, 1604, 1605, 1606, 1607, 1608, 1609, 1610, 1611, 1612, 1613, 1614, 1615, 1616, 1617, 1618, 1619, 1620, 1621, 1622, 1623, 1624, 1625, 1626, 1627, 1628, 1629, 1630, 1631, 1632, 1633, 1634, 1635, 1636, 1637, 1638, 1639, 1640, 1641, 1642, 1643, 1644, 1645, 1646, 1647, 1648, 1649, 1650, 1651, 1652, 1653, 1654, 1655, 1656, 1657, 1658, 1659, 1660, 1661, 1662, 1663, 1664, 1665, 1666, 1667, 1668, 1669, 1670, 1671, 1672, 1673, 1674, 1675, 1676, 1677, 1678, 1679, 1680, 1681, 1682, 1683, 1684, 1685, 1686, 1687, 1688, 1689, 1690, 1691, 1692, 1693, 1694, 1695, 1696, 1697, 1698, 1699, 1700, 1701, 1702, 1703, 1704, 1705, 1706, 1707, 1708, 1709, 1710, 1711, 1712, 1713, 1714, 1715, 1716, 1717, 1718, 1719, 1720, 1721, 1722, 1723, 1724, 1725, 1726, 1727, 1728, 1729, 1730, 1731, 1732, 1733, 1734, 1735, 1736, 1737, 1738, 1739, 1740, 1741, 1742, 1743, 1744, 1745, 1746, 1747, 1748, 1749, 1750, 1751, 1752, 1753, 1754, 1755, 1756, 1757, 1758, 1759, 1760, 1761, 1762, 1763, 1764, 1765, 1766, 1767, 1768, 1769, 1770, 1771, 1772, 1773, 1774, 1775, 1776, 1777, 1778, 1779, 1780, 1781, 1782, 1783, 1784, 1785, 1786, 1787, 1788, 1789, 1790, 1791, 1792, 1793, 1794, 1795, 1796, 1797, 1798, 1799, 1800, 1801, 1802, 1803, 1804, 1805, 1806, 1807, 1808, 1809, 1810, 1811, 1812, 1813, 1814, 1815, 1816, 1817, 1818, 1819, 1820, 1821, 1822, 1823, 1824, 1825, 1826, 1827, 1828, 1829, 1830, 1831, 1832, 1833, 1834, 1835, 1836, 1837, 1838, 1839, 1840, 1841, 1842, 1843, 1844, 1845, 1846, 1847, 1848, 1849, 1850, 1851, 1852, 1853, 1854, 1855, 1856, 1857, 1858, 1859, 1860, 1861, 1862, 1863, 1864, 1865, 1866, 1867, 1868, 1869, 1870, 1871, 1872, 1873, 1874, 1875, 1876, 1877, 1878, 1879, 1880, 1881, 1882, 1883, 1884, 1885, 1886, 1887, 1888, 1889, 1890, 1891, 1892, 1893, 1894, 1895, 1896, 1897, 1898, 1899, 1900, 1901, 1902, 1903, 1904, 1905, 1906, 1907, 1908, 1909, 1910, 1911, 1912, 1913, 1914, 1915, 1916, 1917, 1918, 1919, 1920, 1921, 1922, 1923, 1924, 1925, 1926, 1927, 1928, 1929, 1930, 1931, 1932, 1933, 1934, 1935, 1936, 1937, 1938, 1939, 1940, 1941, 1942, 1943, 1944, 1945, 1946, 1947, 1948, 1949, 1950, 1951, 1952, 1953, 1954, 1955, 1956, 1957, 1958, 1959, 1960, 1961, 1962, 1963, 1964, 1965, 1966, 1967, 1968, 1969, 1970, 1971, 1972, 1973, 1974, 1975, 1976, 1977, 1978, 1979, 1980, 1981, 1982, 1983, 1984, 1985, 1986, 1987, 1988, 1989, 1990, 1991, 1992, 1993, 1994, 1995, 1996, 1997, 1998, 1999, 2000, 2001, 2002, 2003, 2004, 2005, 2006, 2007, 2008, 2009, 2010, 2011, 2012, 2013, 2014, 2015, 2016, 2017, 2018, 2019, 2020, 2021, 2022, 2023, 2024, 2025, 2026, 2027, 2028, 2029, 2030, 2031, 2032, 2033, 2034, 2035, 2036, 2037, 2038, 2039, 2040, 2041, 2042, 2043, 2044, 2045, 2046, 2047, 2048, 2049, 2050, 2051, 2052, 2053, 2054, 2055, 2056, 2057, 2058, 2059, 2060, 2061, 2062, 2063, 2064, 2065, 2066, 2067, 2068, 2069, 2070, 2071, 2072, 2073, 2074, 2075, 2076, 2077, 2078, 2079, 2080, 2081, 2082, 2083, 2084, 2085, 2086, 2087, 2088, 2089, 2090, 2091, 2092, 2093, 2094, 2095, 2096, 2097, 2098, 2099, 2100, 2101, 2102, 2103, 2104, 2105, 2106, 2107, 2108, 2109, 2110, 2111, 2112, 2113, 2114, 2115, 2116, 2117, 2118, 2119, 2120, 2121, 2122, 2123, 2124, 2125, 2126, 2127, 2128, 2129, 2130, 2131, 2132, 2133, 2134, 2135, 2136, 2137, 2138, 2139, 2140, 2141, 2142, 2143, 2144, 2145, 2146, 2147, 2148, 2149, 2150, 2151, 2152, 2153, 2154, 2155, 2156, 2157, 2158, 2159, 2160, 2161, 2162, 2163, 2164, 2165, 2166, 2167, 2168, 2169, 2170, 2171, 2172, 2173, 2174, 2175, 2176, 2177, 2178, 2179, 2180, 2181, 2182, 2183, 2184, 2185, 2186, 2187, 2188, 2189, 2190, 2191, 2192, 2193, 2194, 2195, 2196, 2197, 2198, 2199, 2200, 2201, 2202, 2203, 2204, 2205, 2206, 2207, 2208, 2209, 2210, 2211, 2212, 2213, 2214, 2215, 2216, 2217, 2218, 2219, 2220, 2221, 2222, 2223, 2224, 2225, 2226, 2227, 2228, 2229, 2230, 2231, 2232, 2233, 2234, 2235, 2236, 2237, 2238, 2239, 2240, 2241, 2242, 2243, 2244, 2245, 2246, 2247, 2248, 2249, 2250, 2251, 2252, 2253, 2254, 2255, 2256, 2257, 2258, 2259, 2260, 2261, 2262, 2263, 2264, 2265, 2266, 2267, 2268, 2269, 2270, 2271, 2272, 2273, 2274, 2275, 2276, 2277, 2278, 2279, 2280, 2281, 2282, 2283, 2284, 2285, 2286, 2287, 2288, 2289, 2290, 2291, 2292, 2293, 2294, 2295, 2296, 2297, 2298, 2299, 2300, 2301, 2302, 2303, 2304, 2305, 2306, 2307, 2308, 2309, 2310, 2311, 2312, 2313, 2314, 2315, 2316, 2317, 2318, 2319, 2320, 2321, 2322, 2323, 2324, 2325, 2326, 2327, 2328, 2329, 2330, 2331, 2332, 2333, 2334, 2335, 2336, 2337, 2338, 2339, 2340, 2341, 2342, 2343, 2344, 2345, 2346, 2347, 2348, 2349, 2350, 2351, 2352, 2353, 2354, 2355, 2356, 2357, 2358, 2359, 2360, 2361, 2362, 2363, 2364, 2365, 2366, 2367, 2368, 2369, 2370, 2371, 2372, 2373, 2374, 2375, 2376, 2377, 2378, 2379, 2380, 2381, 2382, 2383, 2384, 2385, 2386, 2387, 2388, 2389, 2390, 2391, 2392, 2393, 2394, 2395, 2396, 2397, 2398, 2399, 2400, 2401, 2402, 2403, 2404, 2405, 2406, 2407, 2408, 2409, 2410, 2411, 2412, 2413, 2414, 2415, 2416, 2417, 2418, 2419, 2420, 2421, 2422, 2423, 2424, 2425, 2426, 2427, 2428, 2429, 2430, 2431, 2432, 2433, 2434, 2435, 2436, 2437, 2438, 2439, 2440, 2441, 2442, 2443, 2444, 2445, 2446, 2447, 2448, 2449, 2450, 2451, 2452, 2453, 2454, 2455, 2456, 2457, 2458, 2459, 2460, 2461, 2462, 2463, 2464, 2465, 2466, 2467, 2468, 2469, 2470, 2471, 2472, 2473, 2474, 2475, 2476, 2477, 2478, 2479, 2480, 2481, 2482, 2483, 2484, 2485, 2486, 2487, 2488, 2489, 2490, 2491, 2492, 2493, 2494, 2495, 2496, 2497, 2498, 2499, 2500, 2501, 2502, 2503, 2504, 2505, 2506, 2507, 2508, 2509, 2510, 2511, 2512, 2513, 2514, 2515, 2516, 2517, 2518, 2519, 2520, 2521, 2522, 2523, 2524, 2525, 2526, 2527, 2528, 2529, 2530, 2531, 2532, 2533, 2534, 2535, 2536, 2537, 2538, 2539, 2540, 2541, 2542, 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, 2605, 2606, 2607, 2608, 2609, 2610, 2611, 2612, 2613, 2614, 2615, 2616, 2617, 2618, 2619, 2620, 2621, 2622, 2623, 2624, 2625, 2626, 2627, 2628, 2629, 2630, 2631, 2632, 2633, 2634, 2635, 2636, 2637, 2638, 2639, 2640, 2641, 2642, 2643, 2644, 2645, 2646, 2647, 2648, 2649, 2650, 2651, 2652, 2653, 2654, 2655, 2656, 2657, 2658, 2659, 2660, 2661, 2662, 2663, 2664, 2665, 2666, 2667, 2668, 2669, 2670, 2671, 2672, 2673, 2674, 2675, 2676, 2677, 2678, 2679, 2680, 2681, 2682, 2683, 2684, 2685, 2686, 2687, 2688, 2689, 2690, 2691, 2692, 2693, 2694, 2695, 2696, 2697, 2698, 2699, 2700, 2701, 2702, 2703, 2704, 2705, 2706, 2707, 2708, 2709, 2710, 2711, 2712, 2713, 2714, 2715, 2716, 2717, 2718, 2719, 2720, 2721, 2722, 2723, 2724, 2725, 2726, 2727, 2728, 2729, 2730, 2731, 2732, 2733, 2734, 2735, 2736, 2737, 2738, 2739, 2740, 2741, 2742, 2743, 2744, 2745, 2746, 2747, 2748, 2749, 2750, 2751, 2752, 2753, 2754, 2755, 2756, 2757, 2758, 2759, 2760, 2761, 2762, 2763, 2764, 2765, 2766, 2767, 2768, 2769, 2770, 2771, 2772, 2773, 2774, 2775, 2776, 2777, 2778, 2779, 2780, 2781, 2782, 2783, 2784, 2785, 2786, 2787, 2788, 2789, 2790, 2791, 2792, 2793, 2794, 2795, 2796, 2797, 2798, 2799, 2800, 2801, 2802, 2803, 2804, 2805, 2806, 2807, 2808, 2809, 2810, 2811, 2812, 2813, 2814, 2815, 2816, 2817, 2818, 2819, 2820, 2821, 2822, 2823, 2824, 2825, 2826, 2827, 2828, 2829, 2830, 2831, 2832, 2833, 2834, 2835, 2836, 2837, 2838, 2839, 2840, 2841, 2842, 2843, 2844, 2845, 2846, 2847, 2848, 2849, 2850, 2851, 2852, 2853, 2854, 2855, 2856, 2857, 2858, 2859, 2860, 2861, 2862, 2863, 2864, 2865, 2866, 2867, 2868, 2869, 2870, 2871, 2872, 2873, 2874, 2875, 2876, 2877, 2878, 2879, 2880, 2881, 2882, 2883, 2884, 2885, 2886, 2887, 2888, 2889, 2890, 2891, 2892, 2893, 2894, 2895, 2896, 2897, 2898, 2899, 2900, 2901, 2902, 2903, 2904, 2905, 2906, 2907, 2908, 2909, 2910, 2911, 2912, 2913, 2914, 2915, 2916, 2917, 2918, 2919, 2920, 2921, 2922, 2923, 2924, 2925, 2926, 2927, 2928, 2929, 2930, 2931, 2932, 2933, 2934, 2935, 2936, 2937, 2938, 2939, 2940, 2941, 2942, 2943, 2944, 2945, 2946, 2947, 2948, 2949, 2950, 2951, 2952, 2953, 2954, 2955, 2956, 2957, 2958, 2959, 2960, 2961, 2962, 2963, 2964, 2965, 2966, 2967, 2968, 2969, 2970, 2971, 2972, 2973, 2974, 2975, 2976, 2977, 2978, 2979, 2980, 2981, 2982, 2983, 2984, 2985, 2986, 2987, 2988, 2989, 2990, 2991, 2992, 2993, 2994, 2995, 2996, 2997, 2998, 2999, 3000, 3001, 3002, 3003, 3004, 3005, 3006, 3007, 3008, 3009, 3010, 3011, 3012, 3013, 3014, 3015, 3016, 3017, 3018, 3019, 3020, 3021, 3022, 3023, 3024, 3025, 3026, 3027, 3028, 3029, 3030, 3031, 3032, 3033, 3034, 3035, 3036, 3037, 3038, 3039, 3040, 3041, 3042, 3043, 3044, 3045, 3046, 3047, 3048, 3049, 3050, 3051, 3052, 3053, 3054, 3055, 3056, 3057, 3058, 3059, 3060, 3061, 3062, 3063, 3064, 3065, 3066, 3067, 3068, 3069, 3070, 3071, 3072, 3073, 3074, 3075, 3076, 3077, 3078, 3079, 3080, 3081, 3082, 3083, 3084, 3085, 3086, 3087, 3088, 3089, 3090, 3091, 3092, 3093, 3094, 3095, 3096, 3097, 3098, 3099, 3100, 3101, 3102, 3103, 3104, 3105, 3106, 3107, 3108, 3109, 3110, 3111, 3112, 3113, 3114, 3115, 3116, 3117, 3118, 3119, 3120, 3121, 3122, 3123, 3124, 3125, 3126, 3127, 3128, 3129, 3130, 3131, 3132, 3133, 3134, 3135, 3136, 3137, 3138, 3139, 3140, 3141, 3142, 3143, 3144, 3145, 3146, 3147, 3148, 3149, 3150, 3151, 3152, 3153, 3154, 3155, 3156, 3157, 3158, 3159, 3160, 3161, 3162, 3163, 3164, 31653166, 3167, 3168, 3169, 3170, 3171, 3172, 3173, 3174, 3175, 3176, 3177, 3178, 3179, 3180, 3181, 3182, 3183, 3184, 3185, 3186, 3187, 3188, 3189, 3190, 3191, 3192, 3193, 3194, 3195, 3196, 3197, 3198, 3199, 3200, 3201, 3202, 3203, 3204, 3205, 3206, 3207, 3208, 3209, 3210, 3211, 3212, 3213, 3214, 3215, 3216, 3217, 3218, 3219, 3220, 3221, 3222, 3223, 3224, 3225, 3226, 3227, 3228, 3229, 3230, 3231, 3232, 3233, 3234, 3235, 3236, 3237, 3238, 3239, 3240, 3241, 3242, 3243, 3244, 3245, 3246, 3247, 3248, 3249, and 3250 nucleotides. The length of any filler region for the viral genome may be 50-100, 100-150, 150-200, 200-250, 250-300, 300-350, 350-400, 400-450, 450-500, 500-550, 550-600, 600-650, 650-700, 700-750, 750-800, 800-850, 850-900, 900-950, 950-1000, 1000-1050, 1050-1100, 1100-1150, 1150-1200, 1200-1250, 1250-1300, 1300-1350, 1350-1400, 1400-1450, 1450-1500, 1500-1550, 1550-1600, 1600-1650, 1650-1700, 1700-1750, 1750-1800, 1800-1850, 1850-1900, 1900-1950, 1950-2000, 2000-2050, 2050-2100, 2100-2150, 2150-2200, 2200-2250, 2250-2300, 2300-2350, 2350-2400, 2400-2450, 2450-2500, 2500-2550, 2550-2600, 2600-2650, 2650-2700, 2700-2750, 2750-2800, 2800-2850, 2850-2900, 2900-2950, 2950-3000, 3000-3050, 3050-3100, 3100-3150, 3150-3200, and 3200-3250 nucleotides. As a non-limiting example, the viral genome comprises a filler region that is about 55 nucleotides in length. As a non-limiting example, the viral genome comprises a filler region that is about 56 nucleotides in length. As a non-limiting example, the viral genome comprises a filler region that is about 97 nucleotides in length. As a non-limiting example, the viral genome comprises a filler region that is about 103 nucleotides in length. As a non-limiting example, the viral genome comprises a filler region that is about 105 nucleotides in length. As a non-limiting example, the viral genome comprises a filler region that is about 357 nucleotides in length. As a non-limiting example, the viral genome comprises a filler region that is about 363 nucleotides in length. As a non-limiting example, the viral genome comprises a filler region that is about 712 nucleotides in length. As a non-limiting example, the viral genome comprises a filler region that is about 714 nucleotides in length. As a non-limiting example, the viral genome comprises a filler region that is about 1203 nucleotides in length. As a non-limiting example, the viral genome comprises a filler region that is about 1209 nucleotides in length. As a non-limiting example, the viral genome comprises a filler region that is about 1512 nucleotides in length. As a non-limiting example, the viral genome comprises a filler region that is about 1519 nucleotides in length. As a non-limiting example, the viral genome comprises a filler region that is about 2395 nucleotides in length. As a non-limiting example, the viral genome comprises a filler region that is about 2403 nucleotides in length. As a non-limiting example, the viral genome comprises a filler region that is about 2405 nucleotides in length. As a non-limiting example, the viral genome comprises a filler region that is about 3013 nucleotides in length. As a non-limiting example, the viral genome comprises a filler region that is about 3021 nucleotides in length.

In one embodiment, the AAV particle viral genome comprises at least one filler sequence regions. Non-limiting examples of filler sequence regions are described in Table 15.

TABLE 15

Filler Sequence Regions

| Sequence Region Name | SEQ ID NO o |
| --- | --- |
| FILL1 | 1390 |
| FILL2 | 1391 |
| FILL3 | 1392 |
| FILL4 | 1393 |
| FILL5 | 1394 |
| FILL6 | 1395 |
| FILL7 | 1396 |
| FILL8 | 1397 |
| FILL9 | 1398 |
| FILL10 | 1399 |
| FILL11 | 1400 |
| FILL12 | 1401 |
| FILL13 | 1402 |
| FILL14 | 1403 |
| FILL15 | 1404 |
| FILL16 | 1405 |
| FILL17 | 1406 |
| FILL18 | 1407 |

In one embodiment, the AAV particle viral genome comprises one filler sequence region. In one embodiment, the filler sequence region is the FILL1 sequence region. In one embodiment, the filler sequence region is the FILL2 sequence region. In one embodiment, the filler sequence region is the FILL3 sequence region. In one embodiment, the filler sequence region is the FILL4 sequence region. In one embodiment, the filler sequence region is the FILL5 sequence region. In one embodiment, the filler sequence region is the FILL6 sequence region. In one embodiment, the filler sequence region is the FILL7 sequence region. In one embodiment, the filler sequence region is the FILL8 sequence region. In one embodiment, the filler sequence region is the FILL9 sequence region. In one embodiment, the filler sequence region is the FILL10 sequence region. In one embodiment, the filler sequence region is the FILL11 sequence region. In one embodiment, the filler sequence region is the FILL12 sequence region. In one embodiment, the filler sequence region is the FILL13 sequence region. In one embodiment, the filler sequence region is the FILL14 sequence region. In one embodiment, the filler sequence region is the FILL15 sequence region. In one embodiment, the filler sequence region is the FILL16 sequence region. In one embodiment, the filler sequence region is the FILL17 sequence region. In one embodiment, the filler sequence region is the FILL18 sequence region.

In one embodiment, the AAV particle viral genome comprises two filler sequence regions. In one embodiment, the two filler sequence regions are the FILL1 sequence region, and the FILL2 sequence region. In one embodiment, the filler sequence region is the FILL1 sequence region, and the FILL3 sequence region. In one embodiment, the filler sequence region is the FILL1 sequence region, and the FILL4 sequence region. In one embodiment, the filler sequence region is the FILL1 sequence region, and the FILL5 sequence region. In one embodiment, the filler sequence region is the FILL1 sequence region, and the FILL6 sequence region. In one embodiment, the filler sequence region is the FILL1 sequence region, and the FILL7 sequence region. In one embodiment, the filler sequence region is the FILL1 sequence region, and the FILL8 sequence region. In one embodiment, the filler sequence region is the FILL1 sequence region, and the FILL9 sequence region. In one embodiment, the filler sequence region is the FILL sequence region, and the FILL10 sequence region. In one embodiment, the filler sequence region is the FILL1 sequence region, and the FILL11 sequence region. In one embodiment, the filler sequence region is the FILL1 sequence region, and the FILL12 sequence region. In one embodiment, the filler sequence region is the FILL1 sequence region, and the FILL13 sequence region. In one embodiment, the filler sequence region is the FILL1 sequence region, and the FILL14 sequence region. In one embodiment, the filler sequence region is the FILL1 sequence region, and the FILL15 sequence region. In one embodiment, the filler sequence region is the FILL1 sequence region, and the FILL16 sequence region. In one embodiment, the filler sequence region is the FILL1 sequence region, and the FILL17 sequence region. In one embodiment, the filler sequence region is the FILL1 sequence region, and the FILL18 sequence region. In one embodiment, the filler sequence region is the FILL2 sequence region, and the FILL3 sequence region. In one embodiment, the filler sequence region is the FILL3 sequence region, and the FILL4 sequence region. In one embodiment, the filler sequence region is the FILL3 sequence region, and the FILL5 sequence region. In one embodiment, the filler sequence region is the FILL3 sequence region, and the FILL6 sequence region. In one embodiment, the filler sequence region is the FILL3 sequence region, and the FILL7 sequence region. In one embodiment, the filler sequence region is the FILL3 sequence region, and the FILL8 sequence region. In one embodiment, the filler sequence region is the FILL3 sequence region, and the FILL9 sequence region. In one embodiment, the filler sequence region is the FILL3 sequence region, and the FILL10 sequence region. In one embodiment, the filler sequence region is the FILL3 sequence region, and the FILL11 sequence region. In one embodiment, the filler sequence region is the FILL3 sequence region, and the FILL12 sequence region. In one embodiment, the filler sequence region is the FILL3 sequence region, and the FILL13 sequence region. In one embodiment, the filler sequence region is the FILL3 sequence region, and the FILL14 sequence region. In one embodiment, the filler sequence region is the FILL3 sequence region, and the FILL15 sequence region. In one embodiment, the filler sequence region is the FILL3 sequence region, and the FILL16 sequence region. In one embodiment, the filler sequence region is the FILL3 sequence region, and the FILL17 sequence region. In one embodiment, the filler sequence region is the FILL3 sequence region, and the FILL18 sequence region. In one embodiment, the filler sequence region is the FILL4 sequence region, and the FILL5 sequence region. In one embodiment, the filler sequence region is the FILL4 sequence region, and the FILL6 sequence region. In one embodiment, the filler sequence region is the FILL4 sequence region, and the FILL7 sequence region. In one embodiment, the filler sequence region is the FILL4 sequence region, and the FILL8 sequence region. In one embodiment, the filler sequence region is the FILL4 sequence region, and the FILL9 sequence region. In one embodiment, the filler sequence region is the FILL4 sequence region, and the FILL10 sequence region. In one embodiment, the filler sequence region is the FILL4 sequence region, and the FILL11 sequence region. In one embodiment, the filler sequence region is the FILL4 sequence region, and the FILL12 sequence region. In one embodiment, the filler sequence region is the FILL4 sequence region, and the FILL13 sequence region. In one embodiment, the filler sequence region is the FILL4 sequence region, and the FILL14 sequence region. In one embodiment, the filler sequence region is the FILL4 sequence region, and the FILL15 sequence region. In one embodiment, the filler sequence region is the FILL4 sequence region, and the FILL16 sequence region. In one embodiment, the filler sequence region is the FILL4 sequence region, and the FILL17 sequence region. In one embodiment, the filler sequence region is the FILL4 sequence region, and the FILL18 sequence region. In one embodiment, the filler sequence region is the FILL5 sequence region, and the FILL6 sequence region. In one embodiment, the filler sequence region is the FILL5 sequence region, and the FILL7 sequence region. In one embodiment, the filler sequence region is the FILL5 sequence region, and the FILL8 sequence region. In one embodiment, the filler sequence region is the FILL5 sequence region, and the FILL9 sequence region. In one embodiment, the filler sequence region is the FILL5 sequence region, and the FILL10 sequence region. In one embodiment, the filler sequence region is the FILL5 sequence region, and the FILL11 sequence region. In one embodiment, the filler sequence region is the FILL5 sequence region, and the FILL12 sequence region. In one embodiment, the filler sequence region is the FILL5 sequence region, and the FILL13 sequence region. In one embodiment, the filler sequence region is the FILL5 sequence region, and the FILL14 sequence region. In one embodiment, the filler sequence region is the FILL5 sequence region, and the FILL15 sequence region. In one embodiment, the filler sequence region is the FILL5 sequence region, and the FILL16 sequence region. In one embodiment, the filler sequence region is the FILL5 sequence region, and the FILL17 sequence region. In one embodiment, the filler sequence region is the FILL5 sequence region, and the FILL18 sequence region. In one embodiment, the filler sequence region is the FILL6 sequence region, and the FILL7 sequence region. In one embodiment, the filler sequence region is the FILL6 sequence region, and the FILL8 sequence region. In one embodiment, the filler sequence region is the FILL6 sequence region, and the FILL9 sequence region. In one embodiment, the filler sequence region is the FILL6 sequence region, and the FILL10 sequence region. In one embodiment, the filler sequence region is the FILL6 sequence region, and the FILL11 sequence region. In one embodiment, the filler sequence region is the FILL6 sequence region, and the FILL12 sequence region. In one embodiment, the filler sequence region is the FILL6 sequence region, and the FILL13 sequence region. In one embodiment, the filler sequence region is the FILL6 sequence region, and the FILL14 sequence region. In one embodiment, the filler sequence region is the FILL6 sequence region, and the FILL15 sequence region. In one embodiment, the filler sequence region is the FILL6 sequence region, and the FILL16 sequence region. In one embodiment, the filler sequence region is the FILL6 sequence region, and the FILL17 sequence region. In one embodiment, the filler sequence region is the FILL6 sequence region, and the FILL18 sequence region. In one embodiment, the filler sequence region is the FILL7 sequence region, and the FILL5 sequence region. In one embodiment, the filler sequence region is the FILL7 sequence region, and the FILL9 sequence region. In one embodiment, the filler sequence region is the FILL7 sequence region, and the FILL10 sequence region. In one embodiment, the filler sequence region is the FILL7 sequence region, and the FILL11 sequence region. In one embodiment, the filler sequence region is the FILL7 sequence region, and the FILL12 sequence region. In one embodiment, the filler sequence region is the FILL7 sequence region, and the FILL13 sequence region. In one embodiment, the filler sequence region is the FILL7 sequence region, and the FILL14 sequence region. In one embodiment, the filler sequence region is the FILL7 sequence region, and the FILL15 sequence region. In one embodiment, the filler sequence region is the FILL7 sequence region, and the FILL16 sequence region. In one embodiment, the filler sequence region is the FILL7 sequence region, and the FILL17 sequence region. In one embodiment, the filler sequence region is the FILL7 sequence region, and the FILL18 sequence region. In one embodiment, the filler sequence region is the FILL5 sequence region, and the FILL9 sequence region. In one embodiment, the filler sequence region is the FILL8 sequence region, and the FILL10 sequence region. In one embodiment, the filler sequence region is the FILL8 sequence region, and the FILL11 sequence region. In one embodiment, the filler sequence region is the FILL8 sequence region, and the FILL12 sequence region. In one embodiment, the filler sequence region is the FILL8 sequence region, and the FILL13 sequence region. In one embodiment, the filler sequence region is the FILL8 sequence region, and the FILL14 sequence region. In one embodiment, the filler sequence region is the FILL8 sequence region, and the FILL15 sequence region. In one embodiment, the filler sequence region is the FILL5 sequence region, and the FILL16 sequence region. In one embodiment, the filler sequence region is the FILL8 sequence region, and the FILL17 sequence region. In one embodiment, the filler sequence region is the FILL8 sequence region, and the FILL18 sequence region. In one embodiment, the filler sequence region is the FILL9 sequence region, and the FILL10 sequence region. In one embodiment, the filler sequence region is the FILL9 sequence region, and the FILL11 sequence region. In one embodiment, the filler sequence region is the FILL9 sequence region, and the FILL12 sequence region. In one embodiment, the filler sequence region is the FILL9 sequence region, and the FILL13 sequence region. In one embodiment, the filler sequence region is the FILL9 sequence region, and the FILL14 sequence region. In one embodiment, the filler sequence region is the FILL9 sequence region, and the FILL15 sequence region. In one embodiment, the filler sequence region is the FILL9 sequence region, and the FILL16 sequence region. In one embodiment, the filler sequence region is the FILL9 sequence region, and the FILL17 sequence region. In one embodiment, the filler sequence region is the FILL9 sequence region, and the FILL18 sequence region. In one embodiment, the filler sequence region is the FILL10 sequence region, and the FILL11 sequence region. In one embodiment, the filler sequence region is the FILL10 sequence region, and the FILL12 sequence region. In one embodiment, the filler sequence region is the FILL10 sequence region, and the FILL13 sequence region. In one embodiment, the filler sequence region is the FILL10 sequence region, and the FILL14 sequence region. In one embodiment, the filler sequence region is the FILL10 sequence region, and the FILL15 sequence region. In one embodiment, the filler sequence region is the FILL10 sequence region, and the FILL16 sequence region. In one embodiment, the filler sequence region is the FILL10 sequence region, and the FILL17 sequence region. In one embodiment, the filler sequence region is the FILL10 sequence region, and the FILL8 sequence region. In one embodiment, the filler sequence region is the FILL11 sequence region, and the FILL12 sequence region. In one embodiment, the filler sequence region is the FILL11 sequence region, and the FILL13 sequence region. In one embodiment, the filler sequence region is the FILL1 sequence region, and the FILL14 sequence region. In one embodiment, the filler sequence region is the FILL11 sequence region, and the FILL15 sequence region. In one embodiment, the filler sequence region is the FILL11 sequence region, and the FILL16 sequence region. In one embodiment, the filler sequence region is the FILL11 sequence region, and the FILL17 sequence region. In one embodiment, the filler sequence region is the FILL11 sequence region, and the FILL18 sequence region. In one embodiment, the filler sequence region is the FILL12 sequence region, and the FILL13 sequence region. In one embodiment, the filler sequence region is the FILL12 sequence region, and the FILL14 sequence region. In one embodiment, the filler sequence region is the FILL12 sequence region, and the FILL15 sequence region. In one embodiment, the filler sequence region is the FILL12 sequence region, and the FILL16 sequence region. In one embodiment, the filler sequence region is the FILL12 sequence region, and the FILL17 sequence region. In one embodiment, the filler sequence region is the FILL12 sequence region, and the FILL18 sequence region. In one embodiment, the filler sequence region is the FILL13 sequence region, and the FILL14 sequence region. In one embodiment, the filler sequence region is the FILL13 sequence region, and the FILL15 sequence region. In one embodiment, the filler sequence region is the FILL13 sequence region, and the FILL16 sequence region. In one embodiment, the filler sequence region is the FILL13 sequence region, and the FILL17 sequence region. In one embodiment, the filler sequence region is the FILL13 sequence region, and the FILL18 sequence region. In one embodiment, the filler sequence region is the FILL14 sequence region, and the FILL15 sequence region. In one embodiment, the filler sequence region is the FILL14 sequence region, and the FILL16 sequence region. In one embodiment, the filler sequence region is the FILL14 sequence region, and the FILL17 sequence region. In one embodiment, the filler sequence region is the FILL14 sequence region, and the FILL18 sequence region. In one embodiment, the filler sequence region is the FILL15 sequence region, and the FILL16 sequence region. In one embodiment, the filler sequence region is the FILL15 sequence region, and the FILL17 sequence region. In one embodiment, the filler sequence region is the FILL15 sequence region, and the FILL18 sequence region. In one embodiment, the filler sequence region is the FILL16 sequence region, and the FILL17 sequence region. In one embodiment, the filler sequence region is the FILL16 sequence region, and the FILL18 sequence region. In one embodiment, the filler sequence region is the FILL17 sequence region, and the FILL18 sequence region.

In one embodiment, the AAV particle viral genome comprises three filler sequence regions. In one embodiment, the two filler sequence regions are the FILL1 sequence region, the FILL2 sequence region, and the FILL3 sequence region. In one embodiment, the filler sequence region is the FILL1 sequence region, the FILL2 sequence region, and the FILL4 sequence region. In one embodiment, the filler sequence region is the FILL1 sequence region, the FILL2 sequence region, and the FILL5 sequence region. In one embodiment, the filler sequence region is the FILL1 sequence region, the FILL2 sequence region, and the FILL6 sequence region. In one embodiment, the filler sequence region is the FILL1 sequence region, the FILL2 sequence region, and the FILL7 sequence region. In one embodiment, the filler sequence region is the FILL1 sequence region, the FILL2 sequence region, and the FILL8 sequence region. In one embodiment, the filler sequence region is the FILL1 sequence region, the FILL2 sequence region, and the FILL9 sequence region. In one embodiment, the filler sequence region is the FILL1 sequence region, the FILL2 sequence region, and the FILL10 sequence region. In one embodiment, the filler sequence region is the FILL1 sequence region, the FILL2 sequence region, and the FILL11 sequence region. In one embodiment, the filler sequence region is the FILL1 sequence region, the FILL2 sequence region, and the FILL12 sequence region. In one embodiment, the filler sequence region is the FILL1 sequence region, the FILL2 sequence region, and the FILL13 sequence region. In one embodiment, the filler sequence region is the FILL1 sequence region, the FILL2 sequence region, and the FILL14 sequence region. In one embodiment, the filler sequence region is the FILL1 sequence region, the FILL2 sequence region, and the FILL15 sequence region. In one embodiment, the filler sequence region is the FILL1 sequence region, the FILL2 sequence region, and the FILL16 sequence region. In one embodiment, the filler sequence region is the FILL1 sequence region, the FILL2 sequence region, and the FILL17 sequence region. In one embodiment, the filler sequence region is the FILL1 sequence region, the FILL2 sequence region, and the FILL18 sequence region. In one embodiment, the filler sequence region is the FILL1 sequence region, the FILL3 sequence region, and the FILL4 sequence region. In one embodiment, the filler sequence region is the FILL1 sequence region, the FILL3 sequence region, and the FILL5 sequence region. In one embodiment, the filler sequence region is the FILL1 sequence region, the FILL3 sequence region, and the FILL6 sequence region. In one embodiment, the filler sequence region is the FILL1 sequence region, the FILL3 sequence region, and the FILL7 sequence region. In one embodiment, the filler sequence region is the FILL1 sequence region, the FILL3 sequence region, and the FILL8 sequence region. In one embodiment, the filler sequence region is the FILL1 sequence region, the FILL3 sequence region, and the FILL9 sequence region. In one embodiment, the filler sequence region is the FILL1 sequence region, the FILL3 sequence region, and the FILL10 sequence region. In one embodiment, the filler sequence region is the FILL1 sequence region, the FILL3 sequence region, and the FILL11 sequence region. In one embodiment, the filler sequence region is the FILL1 sequence region, the FILL3 sequence region, and the FILL12 sequence region. In one embodiment, the filler sequence region is the FILL1 sequence region, the FILL3 sequence region, and the FILL13 sequence region. In one embodiment, the filler sequence region is the FILL1 sequence region, the FILL3 sequence region, and the FILL14 sequence region. In one embodiment, the filler sequence region is the FILL1 sequence region, the FILL3 sequence region, and the FILL15 sequence region. In one embodiment, the filler sequence region is the FILL1 sequence region, the FILL3 sequence region, and the FILL16 sequence region. In one embodiment, the filler sequence region is the FILL1 sequence region, the FILL3 sequence region, and the FILL17 sequence region. In one embodiment, the filler sequence region is the FILL1 sequence region, the FILL3 sequence region, and the FILL18 sequence region. In one embodiment, the filler sequence region is the FILL1 sequence region, the FILL4 sequence region, and the FILL5 sequence region. In one embodiment, the filler sequence region is the FILL1 sequence region, the FILL4 sequence region, and the FILL6 sequence region. In one embodiment, the filler sequence region is the FILL1 sequence region, the FILL4 sequence region, and the FILL7 sequence region. In one embodiment, the filler sequence region is the FILL1 sequence region, the FILL4 sequence region, and the FILL8 sequence region. In one embodiment, the filler sequence region is the FILL1 sequence region, the FILL4 sequence region, and the FILL9 sequence region. In one embodiment, the filler sequence region is the FILL1 sequence region, the FILL4 sequence region, and the FILL10 sequence region. In one embodiment, the filler sequence region is the FILL1 sequence region, the FILL4 sequence region, and the FILL11 sequence region. In one embodiment, the filler sequence region is the FILL1 sequence region, the FILL4 sequence region, and the FILL12 sequence region. In one embodiment, the filler sequence region is the FILL1 sequence region, the FILL4 sequence region, and the FILL13 sequence region. In one embodiment, the filler sequence region is the FILL1 sequence region, the FILL4 sequence region, and the FILL14 sequence region. In one embodiment, the filler sequence region is the FILL1 sequence region, the FILL4 sequence region, and the FILL15 sequence region. In one embodiment, the filler sequence region is the FILL1 sequence region, the FILL4 sequence region, and the FILL16 sequence region. In one embodiment, the filler sequence region is the FILL1 sequence region, the FILL4 sequence region, and the FILL17 sequence region. In one embodiment, the filler sequence region is the FILL1 sequence region, the FILL4 sequence region, and the FILL18 sequence region. In one embodiment, the filler sequence region is the FILL1 sequence region, the FILL5 sequence region, and the FILL6 sequence region. In one embodiment, the filler sequence region is the FILL1 sequence region, the FILL5 sequence region, and the FILL7 sequence region. In one embodiment, the filler sequence region is the FILL1 sequence region, the FILL5 sequence region, and the FILL8 sequence region. In one embodiment, the filler sequence region is the FILL1 sequence region, the FILL5 sequence region, and the FILL9 sequence region. In one embodiment, the filler sequence region is the FILL1 sequence region, the FILL5 sequence region, and the FILL10 sequence region. In one embodiment, the filler sequence region is the FILL1 sequence region, the FILL5 sequence region, and the FILL11 sequence region. In one embodiment, the filler sequence region is the FILL1 sequence region, the FILL5 sequence region, and the FILL12 sequence region. In one embodiment, the filler sequence region is the FILL1 sequence region, the FILL5 sequence region, and the FILL13 sequence region. In one embodiment, the filler sequence region is the FILL1 sequence region, the FILL5 sequence region, and the FILL14 sequence region. In one embodiment, the filler sequence region is the FILL1 sequence region, the FILL5 sequence region, and the FILL15 sequence region. In one embodiment, the filler sequence region is the FILL1 sequence region, the FILL5 sequence region, and the FILL16 sequence region. In one embodiment, the filler sequence region is the FILL1 sequence region, the FILL5 sequence region, and the FILL17 sequence region. In one embodiment, the filler sequence region is the FILL1 sequence region, the FILL5 sequence region, and the FILL18 sequence region. In one embodiment, the filler sequence region is the FILL1 sequence region, the FILL6 sequence region, and the FILL7 sequence region. In one embodiment, the filler sequence region is the FILL1 sequence region, the FILL6 sequence region, and the FILL5 sequence region. In one embodiment, the filler sequence region is the FILL1 sequence region, the FILL6 sequence region, and the FILL9 sequence region. In one embodiment, the filler sequence region is the FILL1 sequence region, the FILL6 sequence region, and the FILL10 sequence region. In one embodiment, the filler sequence region is the FILL1 sequence region, the FILL6 sequence region, and the FILL11 sequence region. In one embodiment, the filler sequence region is the FILL1 sequence region, the FILL6 sequence region, and the FILL12 sequence region. In one embodiment, the filler sequence region is the FILL1 sequence region, the FILL6 sequence region, and the FILL13 sequence region. In one embodiment, the filler sequence region is the FILL1 sequence region, the FILL6 sequence region, and the FILL14 sequence region. In one embodiment, the filler sequence region is the FILL1 sequence region, the FILL6 sequence region, and the FILL15 sequence region. In one embodiment, the filler sequence region is the FILL1 sequence region, the FILL6 sequence region, and the FILL16 sequence region. In one embodiment, the filler sequence region is the FILL1 sequence region, the FILL6 sequence region, and the FILL17 sequence region. In one embodiment, the filler sequence region is the FILL1 sequence region, the FILL6 sequence region, and the FILL18 sequence region. In one embodiment, the filler sequence region is the FILL1 sequence region, the FILL7 sequence region, and the FILL5 sequence region. In one embodiment, the filler sequence region is the FILL1 sequence region, the FILL7 sequence region, and the FILL9 sequence region. In one embodiment, the filler sequence region is the FILL1 sequence region, the FILL7 sequence region, and the FILL10 sequence region. In one embodiment, the filler sequence region is the FILL1 sequence region, the FILL7 sequence region, and the FILL11 sequence region. In one embodiment, the filler sequence region is the FILL1 sequence region, the FILL7 sequence region, and the FILL12 sequence region. In one embodiment, the filler sequence region is the FILL1 sequence region, the FILL7 sequence region, and the FILL13 sequence region. In one embodiment, the filler sequence region is the FILL1 sequence region, the FILL7 sequence region, and the FILL14 sequence region. In one embodiment, the filler sequence region is the FILL1 sequence region, the FILL7 sequence region, and the FILL15 sequence region. In one embodiment, the filler sequence region is the FILL1 sequence region, the FILL7 sequence region, and the FILL16 sequence region. In one embodiment, the filler sequence region is the FILL1 sequence region, the FILL7 sequence region, and the FILL17 sequence region. In one embodiment, the filler sequence region is the FILL1 sequence region, the FILL7 sequence region, and the FILL18 sequence region. In one embodiment, the filler sequence region is the FILL1 sequence region, the FILL8 sequence region, and the FILL9 sequence region. In one embodiment, the filler sequence region is the FILL1 sequence region, the FILL8 sequence region, and the FILL10 sequence region. In one embodiment, the filler sequence region is the FILL1 sequence region, the FILL8 sequence region, and the FILL11 sequence region. In one embodiment, the filler sequence region is the FILL1 sequence region, the FILL8 sequence region, and the FILL12 sequence region. In one embodiment, the filler sequence region is the FILL1 sequence region, the FILL8 sequence region, and the FILL13 sequence region. In one embodiment, the filler sequence region is the FILL1 sequence region, the FILL8 sequence region, and the FILL14 sequence region. In one embodiment, the filler sequence region is the FILL1 sequence region, the FILL8 sequence region, and the FILL15 sequence region. In one embodiment, the filler sequence region is the FILL1 sequence region, the FILL8 sequence region, and the FILL16 sequence region. In one embodiment, the filler sequence region is the FILL1 sequence region, the FILL8 sequence region, and the FILL17 sequence region. In one embodiment, the filler sequence region is the FILL1 sequence region, the FILL8 sequence region, and the FILL18 sequence region. In one embodiment, the filler sequence region is the FILL1 sequence region, the FILL9 sequence region, and the FILL10 sequence region. In one embodiment, the filler sequence region is the FILL1 sequence region, the FILL9 sequence region, and the FILL11 sequence region. In one embodiment, the filler sequence region is the FILL1 sequence region, the FILL9 sequence region, and the FILL12 sequence region. In one embodiment, the filler sequence region is the FILL1 sequence region, the FILL9 sequence region, and the FILL13 sequence region. In one embodiment, the filler sequence region is the FILL1 sequence region, the FILL9 sequence region, and the FILL14 sequence region. In one embodiment, the filler sequence region is the FILL1 sequence region, the FILL9 sequence region, and the FILL15 sequence region. In one embodiment, the filler sequence region is the FILL1 sequence region, the FILL9 sequence region, and the FILL16 sequence region. In one embodiment, the filler sequence region is the FILL1 sequence region, the FILL9 sequence region, and the FILL17 sequence region. In one embodiment, the filler sequence region is the FILL1 sequence region, the FILL9 sequence region, and the FILL18 sequence region. In one embodiment, the filler sequence region is the FILL1 sequence region, the FILL10 sequence region, and the FILL11 sequence region. In one embodiment, the filler sequence region is the FILL1 sequence region, the FILL10 sequence region, and the FILL12 sequence region. In one embodiment, the filler sequence region is the FILL1 sequence region, the FILL10 sequence region, and the FILL13 sequence region. In one embodiment, the filler sequence region is the FILL1 sequence region, the FILL10 sequence region, and the FILL14 sequence region. In one embodiment, the filler sequence region is the FILL1 sequence region, the FILL10 sequence region, and the FILL15 sequence region. In one embodiment, the filler sequence region is the FILL1 sequence region, the FILL10 sequence region, and the FILL16 sequence region. In one embodiment, the filler sequence region is the FILL1 sequence region, the FILL10 sequence region, and the FILL17 sequence region. In one embodiment, the filler sequence region is the FILL1 sequence region, the FILL10 sequence region, and the FILL18 sequence region. In one embodiment, the filler sequence region is the FILL1 sequence region, the FILL11 sequence region, and the FILL12 sequence region. In one embodiment, the filler sequence region is the FILL1 sequence region, the FILL11 sequence region, and the FILL13 sequence region. In one embodiment, the filler sequence region is the FILL1 sequence region, the FILL11 sequence region, and the FILL14 sequence region. In one embodiment, the filler sequence region is the FILL1 sequence region, the FILL11 sequence region, and the FILL15 sequence region. In one embodiment, the filler sequence region is the FILL1 sequence region, the FILL11 sequence region, and the FILL16 sequence region. In one embodiment, the filler sequence region is the FILL1 sequence region, the FILL11 sequence region, and the FILL17 sequence region. In one embodiment, the filler sequence region is the FILL1 sequence region, the FILL11 sequence region, and the FILL18 sequence region. In one embodiment, the filler sequence region is the FILL1 sequence region, the FILL12 sequence region, and the FILL13 sequence region. In one embodiment, the filler sequence region is the FILL1 sequence region, the FILL12 sequence region, and the FILL14 sequence region. In one embodiment, the filler sequence region is the FILL1 sequence region, the FILL12 sequence region, and the FILL15 sequence region. In one embodiment, the filler sequence region is the FILL1 sequence region, the FILL12 sequence region, and the FILL16 sequence region. In one embodiment, the filler sequence region is the FILL1 sequence region, the FILL12 sequence region, and the FILL17 sequence region. In one embodiment, the filler sequence region is the FILL1 sequence region, the FILL12 sequence region, and the FILL18 sequence region. In one embodiment, the filler sequence region is the FILL1 sequence region, the FILL13 sequence region, and the FILL14 sequence region. In one embodiment, the filler sequence region is the FILL1 sequence region, the FILL13 sequence region, and the FILL15 sequence region. In one embodiment, the filler sequence region is the FILL1 sequence region, the FILL13 sequence region, and the FILL16 sequence region. In one embodiment, the filler sequence region is the FILL1 sequence region, the FILL13 sequence region, and the FILL17 sequence region. In one embodiment, the filler sequence region is the FILL1 sequence region, the FILL13 sequence region, and the FILL18 sequence region. In one embodiment, the filler sequence region is the FILL1 sequence region, the FILL14 sequence region, and the FILL15 sequence region. In one embodiment, the filler sequence region is the FILL1 sequence region, the FILL14 sequence region, and the FILL16 sequence region. In one embodiment, the filler sequence region is the FILL1 sequence region, the FILL14 sequence region, and the FILL17 sequence region. In one embodiment, the filler sequence region is the FILL1 sequence region, the FILL14 sequence region, and the FILL18 sequence region. In one embodiment, the filler sequence region is the FILL1 sequence region, the FILL15 sequence region, and the FILL16 sequence region. In one embodiment, the filler sequence region is the FILL1 sequence region, the FILL15 sequence region, and the FILL17 sequence region. In one embodiment, the filler sequence region is the FILL1 sequence region, the FILL15 sequence region, and the FILL18 sequence region. In one embodiment, the filler sequence region is the FILL1 sequence region, the FILL16 sequence region, and the FILL17 sequence region. In one embodiment, the filler sequence region is the FILL1 sequence region, the FILL16 sequence region, and the FILL18 sequence region. In one embodiment, the filler sequence region is the FILL1 sequence region, the FILL17 sequence region, and the FILL18 sequence region. In one embodiment, the filler sequence region is the FILL2 sequence region, the FILL3 sequence region, and the FILL4 sequence region. In one embodiment, the filler sequence region is the FILL2 sequence region, the FILL3 sequence region, and the FILL5 sequence region. In one embodiment, the filler sequence region is the FILL2 sequence region, the FILL3 sequence region, and the FILL6 sequence region. In one embodiment, the filler sequence region is the FILL2 sequence region, the FILL3 sequence region, and the FILL7 sequence region. In one embodiment, the filler sequence region is the FILL2 sequence region, the FILL3 sequence region, and the FILL8 sequence region. In one embodiment, the filler sequence region is the FILL2 sequence region, the FILL3 sequence region, and the FILL9 sequence region. In one embodiment, the filler sequence region is the FILL2 sequence region, the FILL3 sequence region, and the FILL10 sequence region. In one embodiment, the filler sequence region is the FILL2 sequence region, the FILL3 sequence region, and the FILL11 sequence region. In one embodiment, the filler sequence region is the FILL2 sequence region, the FILL3 sequence region, and the FILL12 sequence region. In one embodiment, the filler sequence region is the FILL2 sequence region, the FILL3 sequence region, and the FILL13 sequence region. In one embodiment, the filler sequence region is the FILL2 sequence region, the FILL3 sequence region, and the FILL14 sequence region. In one embodiment, the filler sequence region is the FILL2 sequence region, the FILL3 sequence region, and the FILL15 sequence region. In one embodiment, the filler sequence region is the FILL2 sequence region, the FILL3 sequence region, and the FILL16 sequence region. In one embodiment, the filler sequence region is the FILL2 sequence region, the FILL3 sequence region, and the FILL17 sequence region. In one embodiment, the filler sequence region is the FILL2 sequence region, the FILL3 sequence region, and the FILL18 sequence region. In one embodiment, the filler sequence region is the FILL2 sequence region, the FILL4 sequence region, and the FILL5 sequence region. In one embodiment, the filler sequence region is the FILL2 sequence region, the FILL4 sequence region, and the FILL6 sequence region. In one embodiment, the filler sequence region is the FILL2 sequence region, the FILL4 sequence region, and the FILL7 sequence region. In one embodiment, the filler sequence region is the FILL2 sequence region, the FILL4 sequence region, and the FILL8 sequence region. In one embodiment, the filler sequence region is the FILL2 sequence region, the FILL4 sequence region, and the FILL9 sequence region. In one embodiment, the filler sequence region is the FILL2 sequence region, the FILL4 sequence region, and the FILL10 sequence region. In one embodiment, the filler sequence region is the FILL2 sequence region, the FILL4 sequence region, and the FILL11 sequence region. In one embodiment, the filler sequence region is the FILL2 sequence region, the FILL4 sequence region, and the FILL12 sequence region. In one embodiment, the filler sequence region is the FILL2 sequence region, the FILL4 sequence region, and the FILL13 sequence region. In one embodiment, the filler sequence region is the FILL2 sequence region, the FILL4 sequence region, and the FILL14 sequence region. In one embodiment, the filler sequence region is the FILL2 sequence region, the FILL4 sequence region, and the FILL15 sequence region. In one embodiment, the filler sequence region is the FILL2 sequence region, the FILL4 sequence region, and the FILL16 sequence region. In one embodiment, the filler sequence region is the FILL2 sequence region, the FILL4 sequence region, and the FILL17 sequence region. In one embodiment, the filler sequence region is the FILL2 sequence region, the FILL4 sequence region, and the FILL18 sequence region. In one embodiment, the filler sequence region is the FILL2 sequence region, the FILL5 sequence region, and the FILL6 sequence region. In one embodiment, the filler sequence region is the FILL2 sequence region, the FILL5 sequence region, and the FILL7 sequence region. In one embodiment, the filler sequence region is the FILL2 sequence region, the FILL5 sequence region, and the FILL8 sequence region. In one embodiment, the filler sequence region is the FILL2 sequence region, the FILL5 sequence region, and the FILL9 sequence region. In one embodiment, the filler sequence region is the FILL2 sequence region, the FILL5 sequence region, and the FILL10 sequence region. In one embodiment, the filler sequence region is the FILL2 sequence region, the FILL5 sequence region, and the FILL11 sequence region. In one embodiment, the filler sequence region is the FILL2 sequence region, the FILL5 sequence region, and the FILL12 sequence region. In one embodiment, the filler sequence region is the FILL2 sequence region, the FILL5 sequence region, and the FILL13 sequence region. In one embodiment, the filler sequence region is the FILL2 sequence region, the FILL5 sequence region, and the FILL14 sequence region. In one embodiment, the filler sequence region is the FILL2 sequence region, the FILL5 sequence region, and the FILL15 sequence region. In one embodiment, the filler sequence region is the FILL2 sequence region, the FILL5 sequence region, and the FILL16 sequence region. In one embodiment, the filler sequence region is the FILL2 sequence region, the FILL5 sequence region, and the FILL17 sequence region. In one embodiment, the filler sequence region is the FILL2 sequence region, the FILL5 sequence region, and the FILL18 sequence region. In one embodiment, the filler sequence region is the FILL2 sequence region, the FILL6 sequence region, and the FILL7 sequence region. In one embodiment, the filler sequence region is the FILL2 sequence region, the FILL6 sequence region, and the FILL8 sequence region. In one embodiment, the filler sequence region is the FILL2 sequence region, the FILL6 sequence region, and the FILL9 sequence region. In one embodiment, the filler sequence region is the FILL2 sequence region, the FILL6 sequence region, and the FILL10 sequence region. In one embodiment, the filler sequence region is the FILL2 sequence region, the FILL6 sequence region, and the FILL11 sequence region. In one embodiment, the filler sequence region is the FILL2 sequence region, the FILL6 sequence region, and the FILL12 sequence region. In one embodiment, the filler sequence region is the FILL2 sequence region, the FILL6 sequence region, and the FILL13 sequence region. In one embodiment, the filler sequence region is the FILL2 sequence region, the FILL6 sequence region, and the FILL14 sequence region. In one embodiment, the filler sequence region is the FILL2 sequence region, the FILL6 sequence region, and the FILL15 sequence region. In one embodiment, the filler sequence region is the FILL2 sequence region, the FILL6 sequence region, and the FILL16 sequence region. In one embodiment, the filler sequence region is the FILL2 sequence region, the FILL6 sequence region, and the FILL17 sequence region. In one embodiment, the filler sequence region is the FILL2 sequence region, the FILL6 sequence region, and the FILL18 sequence region. In one embodiment, the filler sequence region is the FILL2 sequence region, the FILL7 sequence region, and the FILL8 sequence region. In one embodiment, the filler sequence region is the FILL2 sequence region, the FILL7 sequence region, and the FILL9 sequence region. In one embodiment, the filler sequence region is the FILL2 sequence region, the FILL7 sequence region, and the FILL10 sequence region. In one embodiment, the filler sequence region is the FILL2 sequence region, the FILL7 sequence region, and the FILL11 sequence region. In one embodiment, the filler sequence region is the FILL2 sequence region, the FILL7 sequence region, and the FILL12 sequence region. In one embodiment, the filler sequence region is the FILL2 sequence region, the FILL7 sequence region, and the FILL13 sequence region. In one embodiment, the filler sequence region is the FILL2 sequence region, the FILL7 sequence region, and the FILL14 sequence region. In one embodiment, the filler sequence region is the FILL2 sequence region, the FILL7 sequence region, and the FILL15 sequence region. In one embodiment, the filler sequence region is the FILL2 sequence region, the FILL7 sequence region, and the FILL16 sequence region. In one embodiment, the filler sequence region is the FILL2 sequence region, the FILL7 sequence region, and the FILL17 sequence region. In one embodiment, the filler sequence region is the FILL2 sequence region, the FILL7 sequence region, and the FILL18 sequence region. In one embodiment, the filler sequence region is the FILL2 sequence region, the FILL8 sequence region, and the FILL9 sequence region. In one embodiment, the filler sequence region is the FILL2 sequence region, the FILL8 sequence region, and the FILL10 sequence region. In one embodiment, the filler sequence region is the FILL2 sequence region, the FILL8 sequence region, and the FILL11 sequence region. In one embodiment, the filler sequence region is the FILL2 sequence region, the FILL8 sequence region, and the FILL12 sequence region. In one embodiment, the filler sequence region is the FILL2 sequence region, the FILL8 sequence region, and the FILL13 sequence region. In one embodiment, the filler sequence region is the FILL2 sequence region, the FILL8 sequence region, and the FILL14 sequence region. In one embodiment, the filler sequence region is the FILL2 sequence region, the FILL8 sequence region, and the FILL15 sequence region. In one embodiment, the filler sequence region is the FILL2 sequence region, the FILL8 sequence region, and the FILL16 sequence region. In one embodiment, the filler sequence region is the FILL2 sequence region, the FILL8 sequence region, and the FILL17 sequence region. In one embodiment, the filler sequence region is the FILL2 sequence region, the FILL8 sequence region, and the FILL18 sequence region. In one embodiment, the filler sequence region is the FILL2 sequence region, the FILL9 sequence region, and the FILL10 sequence region. In one embodiment, the filler sequence region is the FILL2 sequence region, the FILL9 sequence region, and the FILL11 sequence region. In one embodiment, the filler sequence region is the FILL2 sequence region, the FILL9 sequence region, and the FILL12 sequence region. In one embodiment, the filler sequence region is the FILL2 sequence region, the FILL9 sequence region, and the FILL13 sequence region. In one embodiment, the filler sequence region is the FILL2 sequence region, the FILL9 sequence region, and the FILL14 sequence region. In one embodiment, the filler sequence region is the FILL2 sequence region, the FILL9 sequence region, and the FILL15 sequence region. In one embodiment, the filler sequence region is the FILL2 sequence region, the FILL9 sequence region, and the FILL16 sequence region. In one embodiment, the filler sequence region is the FILL2 sequence region, the FILL9 sequence region, and the FILL17 sequence region. In one embodiment, the filler sequence region is the FILL2 sequence region, the FILL9 sequence region, and the FILL18 sequence region. In one embodiment, the filler sequence region is the FILL2 sequence region, the FILL10 sequence region, and the FILL11 sequence region. In one embodiment, the filler sequence region is the FILL2 sequence region, the FILL10 sequence region, and the FILL12 sequence region. In one embodiment, the filler sequence region is the FILL2 sequence region, the FILL10 sequence region, and the FILL13 sequence region. In one embodiment, the filler sequence region is the FILL2 sequence region, the FILL10 sequence region, and the FILL14 sequence region. In one embodiment, the filler sequence region is the FILL2 sequence region, the FILL10 sequence region, and the FILL15 sequence region. In one embodiment, the filler sequence region is the FILL2 sequence region, the FILL10 sequence region, and the FILL16 sequence region. In one embodiment, the filler sequence region is the FILL2 sequence region, the FILL10 sequence region, and the FILL17 sequence region. In one embodiment, the filler sequence region is the FILL2 sequence region, the FILL10 sequence region, and the FILL18 sequence region. In one embodiment, the filler sequence region is the FILL2 sequence region, the FILL11 sequence region, and the FILL12 sequence region. In one embodiment, the filler sequence region is the FILL2 sequence region, the FILL11 sequence region, and the FILL13 sequence region. In one embodiment, the filler sequence region is the FILL2 sequence region, the FILL11 sequence region, and the FILL14 sequence region. In one embodiment, the filler sequence region is the FILL2 sequence region, the FILL11 sequence region, and the FILL15 sequence region. In one embodiment, the filler sequence region is the FILL2 sequence region, the FILL11 sequence region, and the FILL16 sequence region. In one embodiment, the filler sequence region is the FILL2 sequence region, the FILL11 sequence region, and the FILL17 sequence region. In one embodiment, the filler sequence region is the FILL2 sequence region, the FILL11 sequence region, and the FILL18 sequence region. In one embodiment, the filler sequence region is the FILL2 sequence region, the FILL12 sequence region, and the FILL13 sequence region. In one embodiment, the filler sequence region is the FILL2 sequence region, the FILL12 sequence region, and the FILL14 sequence region. In one embodiment, the filler sequence region is the FILL2 sequence region, the FILL12 sequence region, and the FILL15 sequence region. In one embodiment, the filler sequence region is the FILL2 sequence region, the FILL12 sequence region, and the FILL16 sequence region. In one embodiment, the filler sequence region is the FILL2 sequence region, the FILL12 sequence region, and the FILL17 sequence region. In one embodiment, the filler sequence region is the FILL2 sequence region, the FILL12 sequence region, and the FILL18 sequence region. In one embodiment, the filler sequence region is the FILL2 sequence region, the FILL13 sequence region, and the FILL14 sequence region. In one embodiment, the filler sequence region is the FILL2 sequence region, the FILL13 sequence region, and the FILL15 sequence region. In one embodiment, the filler sequence region is the FILL2 sequence region, the FILL13 sequence region, and the FILL16 sequence region. In one embodiment, the filler sequence region is the FILL2 sequence region, the FILL13 sequence region, and the FILL17 sequence region. In one embodiment, the filler sequence region is the FILL2 sequence region, the FILL13 sequence region, and the FILL18 sequence region. In one embodiment, the filler sequence region is the FILL2 sequence region, the FILL14 sequence region, and the FILL15 sequence region. In one embodiment, the filler sequence region is the FILL2 sequence region, the FILL14 sequence region, and the FILL16 sequence region. In one embodiment, the filler sequence region is the FILL2 sequence region, the FILL14 sequence region, and the FILL17 sequence region. In one embodiment, the filler sequence region is the FILL2 sequence region, the FILL14 sequence region, and the FILL18 sequence region. In one embodiment, the filler sequence region is the FILL2 sequence region, the FILL15 sequence region, and the FILL16 sequence region. In one embodiment, the filler sequence region is the FILL2 sequence region, the FILL15 sequence region, and the FILL17 sequence region. In one embodiment, the filler sequence region is the FILL2 sequence region, the FILL15 sequence region, and the FILL18 sequence region. In one embodiment, the filler sequence region is the FILL2 sequence region, the FILL16 sequence region, and the FILL17 sequence region. In one embodiment, the filler sequence region is the FILL2 sequence region, the FILL16 sequence region, and the FILL18 sequence region. In one embodiment, the filler sequence region is the FILL2 sequence region, the FILL17 sequence region, and the FILL18 sequence region. In one embodiment, the filler sequence region is the FILL3 sequence region, the FILL4 sequence region, and the FILL5 sequence region. In one embodiment, the filler sequence region is the FILL3 sequence region, the FILL4 sequence region, and the FILL6 sequence region. In one embodiment, the filler sequence region is the FILL3 sequence region, the FILL4 sequence region, and the FILL7 sequence region. In one embodiment, the filler sequence region is the FILL3 sequence region, the FILL4 sequence region, and the FILL8 sequence region. In one embodiment, the filler sequence region is the FILL3 sequence region, the FILL4 sequence region, and the FILL9 sequence region. In one embodiment, the filler sequence region is the FILL3 sequence region, the FILL4 sequence region, and the FILL10 sequence region. In one embodiment, the filler sequence region is the FILL3 sequence region, the FILL4 sequence region, and the FILL11 sequence region. In one embodiment, the filler sequence region is the FILL3 sequence region, the FILL4 sequence region, and the FILL12 sequence region. In one embodiment, the filler sequence region is the FILL3 sequence region, the FILL4 sequence region, and the FILL13 sequence region. In one embodiment, the filler sequence region is the FILL3 sequence region, the FILL4 sequence region, and the FILL14 sequence region. In one embodiment, the filler sequence region is the FILL3 sequence region, the FILL4 sequence region, and the FILL15 sequence region. In one embodiment, the filler sequence region is the FILL3 sequence region, the FILL4 sequence region, and the FILL16 sequence region. In one embodiment, the filler sequence region is the FILL3 sequence region, the FILL4 sequence region, and the FILL17 sequence region. In one embodiment, the filler sequence region is the FILL3 sequence region, the FILL4 sequence region, and the FILL18 sequence region. In one embodiment, the filler sequence region is the FILL3 sequence region, the FILL5 sequence region, and the FILL6 sequence region. In one embodiment, the filler sequence region is the FILL3 sequence region, the FILL5 sequence region, and the FILL7 sequence region. In one embodiment, the filler sequence region is the FILL3 sequence region, the FILL5 sequence region, and the FILL8 sequence region. In one embodiment, the filler sequence region is the FILL3 sequence region, the FILL5 sequence region, and the FILL9 sequence region. In one embodiment, the filler sequence region is the FILL3 sequence region, the FILL5 sequence region, and the FILL10 sequence region. In one embodiment, the filler sequence region is the FILL3 sequence region, the FILL5 sequence region, and the FILL11 sequence region. In one embodiment, the filler sequence region is the FILL3 sequence region, the FILL5 sequence region, and the FILL12 sequence region. In one embodiment, the filler sequence region is the FILL3 sequence region, the FILL5 sequence region, and the FILL13 sequence region. In one embodiment, the filler sequence region is the FILL3 sequence region, the FILL5 sequence region, and the FILL14 sequence region. In one embodiment, the filler sequence region is the FILL3 sequence region, the FILL5 sequence region, and the FILL15 sequence region. In one embodiment, the filler sequence region is the FILL3 sequence region, the FILL5 sequence region, and the FILL16 sequence region. In one embodiment, the filler sequence region is the FILL3 sequence region, the FILL5 sequence region, and the FILL17 sequence region. In one embodiment, the filler sequence region is the FILL3 sequence region, the FILL5 sequence region, and the FILL18 sequence region. In one embodiment, the filler sequence region is the FILL3 sequence region, the FILL6 sequence region, and the FILL7 sequence region. In one embodiment, the filler sequence region is the FILL3 sequence region, the FILL6 sequence region, and the FILL8 sequence region. In one embodiment, the filler sequence region is the FILL3 sequence region, the FILL6 sequence region, and the FILL9 sequence region. In one embodiment, the filler sequence region is the FILL3 sequence region, the FILL6 sequence region, and the FILL10 sequence region. In one embodiment, the filler sequence region is the FILL3 sequence region, the FILL6 sequence region, and the FILL11 sequence region. In one embodiment, the filler sequence region is the FILL3 sequence region, the FILL6 sequence region, and the FILL12 sequence region. In one embodiment, the filler sequence region is the FILL3 sequence region, the FILL6 sequence region, and the FILL13 sequence region. In one embodiment, the filler sequence region is the FILL3 sequence region, the FILL6 sequence region, and the FILL14 sequence region. In one embodiment, the filler sequence region is the FILL3 sequence region, the FILL6 sequence region, and the FILL IS sequence region. In one embodiment, the filler sequence region is the FILL3 sequence region, the FILL6 sequence region, and the FILL16 sequence region. In one embodiment, the filler sequence region is the FILL3 sequence region, the FILL6 sequence region, and the FILL17 sequence region. In one embodiment, the filler sequence region is the FILL3 sequence region, the FILL6 sequence region, and the FILL18 sequence region. In one embodiment, the filler sequence region is the FILL3 sequence region, the FILL7 sequence region, and the FILL8 sequence region. In one embodiment, the filler sequence region is the FILL3 sequence region, the FILL7 sequence region, and the FILL9 sequence region. In one embodiment, the filler sequence region is the FILL3 sequence region, the FILL7 sequence region, and the FILL10 sequence region. In one embodiment, the filler sequence region is the FILL3 sequence region, the FILL7 sequence region, and the FILL11 sequence region. In one embodiment, the filler sequence region is the FILL3 sequence region, the FILL7 sequence region, and the FILL12 sequence region. In one embodiment, the filler sequence region is the FILL3 sequence region, the FILL7 sequence region, and the FILL13 sequence region. In one embodiment, the filler sequence region is the FILL3 sequence region, the FILL7 sequence region, and the FILL14 sequence region. In one embodiment, the filler sequence region is the FILL3 sequence region, the FILL7 sequence region, and the FILL15 sequence region. In one embodiment, the filler sequence region is the FILL3 sequence region, the FILL7 sequence region, and the FILL16 sequence region. In one embodiment, the filler sequence region is the FILL3 sequence region, the FILL7 sequence region, and the FILL17 sequence region. In one embodiment, the filler sequence region is the FILL3 sequence region, the FILL7 sequence region, and the FILL18 sequence region. In one embodiment, the filler sequence region is the FILL3 sequence region, the FILL8 sequence region, and the FILL9 sequence region. In one embodiment, the filler sequence region is the FILL3 sequence region, the FILL8 sequence region, and the FILL10 sequence region. In one embodiment, the filler sequence region is the FILL3 sequence region, the FILL8 sequence region, and the FILL11 sequence region. In one embodiment, the filler sequence region is the FILL3 sequence region, the FILL8 sequence region, and the FILL12 sequence region. In one embodiment, the filler sequence region is the FILL3 sequence region, the FILL8 sequence region, and the FILL13 sequence region. In one embodiment, the filler sequence region is the FILL3 sequence region, the FILL8 sequence region, and the FILL14 sequence region. In one embodiment, the filler sequence region is the FILL3 sequence region, the FILL8 sequence region, and the FILL15 sequence region. In one embodiment, the filler sequence region is the FILL3 sequence region, the FILL8 sequence region, and the FILL16 sequence region. In one embodiment, the filler sequence region is the FILL3 sequence region, the FILL8 sequence region, and the FILL17 sequence region. In one embodiment, the filler sequence region is the FILL3 sequence region, the FILL5 sequence region, and the FILL18 sequence region. In one embodiment, the filler sequence region is the FILL3 sequence region, the FILL9 sequence region, and the FILL10 sequence region. In one embodiment, the filler sequence region is the FILL3 sequence region, the FILL9 sequence region, and the FILL11 sequence region. In one embodiment, the filler sequence region is the FILL3 sequence region, the FILL9 sequence region, and the FILL12 sequence region. In one embodiment, the filler sequence region is the FILL3 sequence region, the FILL9 sequence region, and the FILL13 sequence region. In one embodiment, the filler sequence region is the FILL3 sequence region, the FILL9 sequence region, and the FILL14 sequence region. In one embodiment, the filler sequence region is the FILL3 sequence region, the FILL9 sequence region, and the FILL15 sequence region. In one embodiment, the filler sequence region is the FILL3 sequence region, the FILL9 sequence region, and the FILL16 sequence region. In one embodiment, the filler sequence region is the FILL3 sequence region, the FILL9 sequence region, and the FILL17 sequence region. In one embodiment, the filler sequence region is the FILL3 sequence region, the FILL9 sequence region, and the FILL18 sequence region. In one embodiment, the filler sequence region is the FILL3 sequence region, the FILL10 sequence region, and the FILL11 sequence region. In one embodiment, the filler sequence region is the FILL3 sequence region, the FILL10 sequence region, and the FILL12 sequence region. In one embodiment, the filler sequence region is the FILL3 sequence region, the FILL10 sequence region, and the FILL13 sequence region. In one embodiment, the filler sequence region is the FILL3 sequence region, the FILL10 sequence region, and the FILL14 sequence region. In one embodiment, the filler sequence region is the FILL3 sequence region, the FILL10 sequence region, and the FILL15 sequence region. In one embodiment, the filler sequence region is the FILL3 sequence region, the FILL10 sequence region, and the FILL16 sequence region. In one embodiment, the filler sequence region is the FILL3 sequence region, the FILL10 sequence region, and the FILL17 sequence region. In one embodiment, the filler sequence region is the FILL3 sequence region, the FILL10 sequence region, and the FILL18 sequence region. In one embodiment, the filler sequence region is the FILL3 sequence region, the FILL11 sequence region, and the FILL12 sequence region. In one embodiment, the filler sequence region is the FILL3 sequence region, the FILL11 sequence region, and the FILL13 sequence region. In one embodiment, the filler sequence region is the FILL3 sequence region, the FILL11 sequence region, and the FILL14 sequence region. In one embodiment, the filler sequence region is the FILL3 sequence region, the FILL11 sequence region, and the FILL15 sequence region. In one embodiment, the filler sequence region is the FILL3 sequence region, the FILL11 sequence region, and the FILL16 sequence region. In one embodiment, the filler sequence region is the FILL3 sequence region, the FILL11 sequence region, and the FILL17 sequence region. In one embodiment, the filler sequence region is the FILL3 sequence region, the FILL11 sequence region, and the FILL18 sequence region. In one embodiment, the filler sequence region is the FILL3 sequence region, the FILL12 sequence region, and the FILL13 sequence region. In one embodiment, the filler sequence region is the FILL3 sequence region, the FILL12 sequence region, and the FILL14 sequence region. In one embodiment, the filler sequence region is the FILL3 sequence region, the FILL12 sequence region, and the FILL15 sequence region. In one embodiment, the filler sequence region is the FILL3 sequence region, the FILL12 sequence region, and the FILL16 sequence region. In one embodiment, the filler sequence region is the FILL3 sequence region, the FILL12 sequence region, and the FILL17 sequence region. In one embodiment, the filler sequence region is the FILL3 sequence region, the FILL12 sequence region, and the FILL18 sequence region. In one embodiment, the filler sequence region is the FILL3 sequence region, the FILL13 sequence region, and the FILL14 sequence region. In one embodiment, the filler sequence region is the FILL3 sequence region, the FILL13 sequence region, and the FILL15 sequence region. In one embodiment, the filler sequence region is the FILL3 sequence region, the FILL13 sequence region, and the FILL16 sequence region. In one embodiment, the filler sequence region is the FILL3 sequence region, the FILL13 sequence region, and the FILL17 sequence region. In one embodiment, the filler sequence region is the FILL3 sequence region, the FILL13 sequence region, and the FILL18 sequence region. In one embodiment, the filler sequence region is the FILL3 sequence region, the FILL14 sequence region, and the FILL15 sequence region. In one embodiment, the filler sequence region is the FILL3 sequence region, the FILL14 sequence region, and the FILL16 sequence region. In one embodiment, the filler sequence region is the FILL3 sequence region, the FILL14 sequence region, and the FILL17 sequence region. In one embodiment, the filler sequence region is the FILL3 sequence region, the FILL14 sequence region, and the FILL18 sequence region. In one embodiment, the filler sequence region is the FILL3 sequence region, the FILL15 sequence region, and the FILL16 sequence region. In one embodiment, the filler sequence region is the FILL3 sequence region, the FILL15 sequence region, and the FILL17 sequence region. In one embodiment, the filler sequence region is the FILL3 sequence region, the FILL15 sequence region, and the FILL18 sequence region. In one embodiment, the filler sequence region is the FILL3 sequence region, the FILL16 sequence region, and the FILL17 sequence region. In one embodiment, the filler sequence region is the FILL3 sequence region, the FILL16 sequence region, and the FILL18 sequence region. In one embodiment, the filler sequence region is the FILL3 sequence region, the FILL17 sequence region, and the FILL18 sequence region. In one embodiment, the filler sequence region is the FILL4 sequence region, the FILL5 sequence region, and the FILL6 sequence region. In one embodiment, the filler sequence region is the FILL4 sequence region, the FILL5 sequence region, and the FILL7 sequence region. In one embodiment, the filler sequence region is the FILL4 sequence region, the FILL5 sequence region, and the FILL8 sequence region. In one embodiment, the filler sequence region is the FILL4 sequence region, the FILL5 sequence region, and the FILL9 sequence region. In one embodiment, the filler sequence region is the FILL4 sequence region, the FILL5 sequence region, and the FILL10 sequence region. In one embodiment, the filler sequence region is the FILL4 sequence region, the FILL5 sequence region, and the FILL11 sequence region. In one embodiment, the filler sequence region is the FILL4 sequence region, the FILL5 sequence region, and the FILL12 sequence region. In one embodiment, the filler sequence region is the FILL4 sequence region, the FILL5 sequence region, and the FILL13 sequence region. In one embodiment, the filler sequence region is the FILL4 sequence region, the FILL5 sequence region, and the FILL14 sequence region. In one embodiment the filler sequence region is the FILL4 sequence region, the FILL5 sequence region, and the FILL15 sequence region. In one embodiment, the filler sequence region is the FILL4 sequence region, the FILL5 sequence region, and the FILL16 sequence region. In one embodiment, the filler sequence region is the FILL4 sequence region, the FILL5 sequence region, and the FILL17 sequence region. In one embodiment, the filler sequence region is the FILL4 sequence region, the FILL5 sequence region, and the FILL18 sequence region. In one embodiment, the filler sequence region is the FILL4 sequence region, the FILL6 sequence region, and the FILL7 sequence region. In one embodiment, the filler sequence region is the FILL4 sequence region, the FILL6 sequence region, and the FILL8 sequence region. In one embodiment, the filler sequence region is the FILL4 sequence region, the FILL6 sequence region, and the FILL9 sequence region. In one embodiment, the filler sequence region is the FILL4 sequence region, the FILL6 sequence region, and the FILL10 sequence region. In one embodiment, the filler sequence region is the FILL4 sequence region, the FILL6 sequence region, and the FILL11 sequence region. In one embodiment, the filler sequence region is the FILL4 sequence region, the FILL6 sequence region, and the FILL12 sequence region. In one embodiment, the filler sequence region is the FILL4 sequence region, the FILL6 sequence region, and the FILL13 sequence region. In one embodiment, the filler sequence region is the FILL4 sequence region, the FILL6 sequence region, and the FILL14 sequence region. In one embodiment, the filler sequence region is the FILL4 sequence region, the FILL6 sequence region, and the FILL15 sequence region. In one embodiment, the filler sequence region is the FILL4 sequence region, the FILL6 sequence region, and the FILL16 sequence region. In one embodiment, the filler sequence region is the FILL4 sequence region, the FILL6 sequence region, and the FILL17 sequence region. In one embodiment, the filler sequence region is the FILL4 sequence region, the FILL6 sequence region, and the FILL18 sequence region. In one embodiment, the filler sequence region is the FILL4 sequence region, the FILL7 sequence region, and the FILL8 sequence region. In one embodiment, the filler sequence region is the FILL4 sequence region, the FILL7 sequence region, and the FILL9 sequence region. In one embodiment, the filler sequence region is the FILL4 sequence region, the FILL7 sequence region, and the FILL10 sequence region. In one embodiment, the filler sequence region is the FILL4 sequence region, the FILL7 sequence region, and the FILL11 sequence region. In one embodiment, the filler sequence region is the FILL4 sequence region, the FILL7 sequence region, and the FILL12 sequence region. In one embodiment, the filler sequence region is the FILL4 sequence region, the FILL7 sequence region, and the FILL13 sequence region. In one embodiment, the filler sequence region is the FILL4 sequence region, the FILL7 sequence region, and the FILL14 sequence region. In one embodiment, the filler sequence region is the FILL4 sequence region, the FILL7 sequence region, and the FILL15 sequence region. In one embodiment, the filler sequence region is the FILL4 sequence region, the FILL7 sequence region, and the FILL16 sequence region. In one embodiment, the filler sequence region is the FILL4 sequence region, the FILL7 sequence region, and the FILL17 sequence region. In one embodiment, the filler sequence region is the FILL4 sequence region, the FILL7 sequence region, and the FILL18 sequence region. In one embodiment, the filler sequence region is the FILL4 sequence region, the FILL8 sequence region, and the FILL9 sequence region. In one embodiment, the filler sequence region is the FILL4 sequence region, the FILL8 sequence region, and the FILL10 sequence region. In one embodiment, the filler sequence region is the FILL4 sequence region, the FILL8 sequence region, and the FILL11 sequence region. In one embodiment, the filler sequence region is the FILL4 sequence region, the FILL8 sequence region, and the FILL12 sequence region. In one embodiment, the filler sequence region is the FILL4 sequence region, the FILL8 sequence region, and the FILL13 sequence region. In one embodiment, the filler sequence region is the FILL4 sequence region, the FILL8 sequence region, and the FILL14 sequence region. In one embodiment, the filler sequence region is the FILL4 sequence region, the FILL8 sequence region, and the FILL15 sequence region. In one embodiment, the filler sequence region is the FILL4 sequence region, the FILL8 sequence region, and the FILL16 sequence region. In one embodiment, the filler sequence region is the FILL4 sequence region, the FILL8 sequence region, and the FILL17 sequence region. In one embodiment, the filler sequence region is the FILL4 sequence region, the FILL8 sequence region, and the FILL18 sequence region. In one embodiment, the filler sequence region is the FILL4 sequence region, the FILL9 sequence region, and the FILL10 sequence region. In one embodiment, the filler sequence region is the FILL4 sequence region, the FILL9 sequence region, and the FILL11 sequence region. In one embodiment, the filler sequence region is the FILL4 sequence region, the FILL9 sequence region, and the FILL12 sequence region. In one embodiment, the filler sequence region is the FILL4 sequence region, the FILL9 sequence region, and the FILL13 sequence region. In one embodiment, the filler sequence region is the FILL4 sequence region, the FILL9 sequence region, and the FILL14 sequence region. In one embodiment, the filler sequence region is the FILL4 sequence region, the FILL9 sequence region, and the FILL15 sequence region. In one embodiment, the filler sequence region is the FILL4 sequence region, the FILL9 sequence region, and the FILL16 sequence region. In one embodiment, the filler sequence region is the FILL4 sequence region, the FILL9 sequence region, and the FILL17 sequence region. In one embodiment, the filler sequence region is the FILL4 sequence region, the FILL9 sequence region, and the FILL18 sequence region. In one embodiment, the filler sequence region is the FILL4 sequence region, the FILL10 sequence region, and the FILL11 sequence region. In one embodiment, the filler sequence region is the FILL4 sequence region, the FILL10 sequence region, and the FILL12 sequence region. In one embodiment, the filler sequence region is the FILL4 sequence region, the FILL10 sequence region, and the FILL13 sequence region. In one embodiment, the filler sequence region is the FILL4 sequence region, the FILL10 sequence region, and the FILL14 sequence region. In one embodiment, the filler sequence region is the FILL4 sequence region, the FILL10 sequence region, and the FILL15 sequence region. In one embodiment, the filler sequence region is the FILL4 sequence region, the FILL10 sequence region, and the FILL16 sequence region. In one embodiment, the filler sequence region is the FILL4 sequence region, the FILL10 sequence region, and the FILL17 sequence region. In one embodiment, the filler sequence region is the FILL4 sequence region, the FILL10 sequence region, and the FILL18 sequence region. In one embodiment, the filler sequence region is the FILL4 sequence region, the FILL11 sequence region, and the FILL12 sequence region. In one embodiment, the filler sequence region is the FILL4 sequence region, the FILL11 sequence region, and the FILL13 sequence region. In one embodiment, the filler sequence region is the FILL4 sequence region, the FILL11 sequence region, and the FILL14 sequence region. In one embodiment, the filler sequence region is the FILL4 sequence region, the FILL11 sequence region, and the FILL15 sequence region. In one embodiment, the filler sequence region is the FILL4 sequence region, the FILL11 sequence region, and the FILL16 sequence region. In one embodiment, the filler sequence region is the FILL4 sequence region, the FILL11 sequence region, and the FILL17 sequence region. In one embodiment, the filler sequence region is the FILL4 sequence region, the FILL11 sequence region, and the FILL18 sequence region. In one embodiment, the filler sequence region is the FILL4 sequence region, the FILL12 sequence region, and the FILL13 sequence region. In one embodiment, the filler sequence region is the FILL4 sequence region, the FILL12 sequence region, and the FILL14 sequence region. In one embodiment, the filler sequence region is the FILL4 sequence region, the FILL12 sequence region, and the FILL15 sequence region. In one embodiment, the filler sequence region is the FILL4 sequence region, the FILL12 sequence region, and the FILL16 sequence region. In one embodiment, the filler sequence region is the FILL4 sequence region, the FILL12 sequence region, and the FILL17 sequence region. In one embodiment, the filler sequence region is the FILL4 sequence region, the FILL12 sequence region, and the FILL18 sequence region. In one embodiment, the filler sequence region is the FILL4 sequence region, the FILL13 sequence region, and the FILL14 sequence region. In one embodiment, the filler sequence region is the FILL4 sequence region, the FILL13 sequence region, and the FILL15 sequence region. In one embodiment, the filler sequence region is the FILL4 sequence region, the FILL13 sequence region, and the FILL16 sequence region. In one embodiment, the filler sequence region is the FILL4 sequence region, the FILL13 sequence region, and the FILL17 sequence region. In one embodiment, the filler sequence region is the FILL4 sequence region, the FILL13 sequence region, and the FILL18 sequence region. In one embodiment, the filler sequence region is the FILL4 sequence region, the FILL14 sequence region, and the FILL15 sequence region. In one embodiment, the filler sequence region is the FILL4 sequence region, the FILL14 sequence region, and the FILL16 sequence region. In one embodiment, the filler sequence region is the FILL4 sequence region, the FILL14 sequence region, and the FILL17 sequence region. In one embodiment, the filler sequence region is the FILL4 sequence region, the FILL14 sequence region, and the FILL18 sequence region. In one embodiment, the filler sequence region is the FILL4 sequence region, the FILL15 sequence region, and the FILL16 sequence region. In one embodiment, the filler sequence region is the FILL4 sequence region, the FILL15 sequence region, and the FILL17 sequence region. In one embodiment, the filler sequence region is the FILL4 sequence region, the FILL15 sequence region, and the FILL18 sequence region. In one embodiment, the filler sequence region is the FILL4 sequence region, the FILL16 sequence region, and the FILL17 sequence region. In one embodiment, the filler sequence region is the FILL4 sequence region, the FILL16 sequence region, and the FILL18 sequence region. In one embodiment, the filler sequence region is the FILL4 sequence region, the FILL17 sequence region, and the FILL18 sequence region. In one embodiment, the filler sequence region is the FILL5 sequence region, the FILL6 sequence region, and the FILL7 sequence region. In one embodiment, the filler sequence region is the FILL5 sequence region, the FILL6 sequence region, and the FILL8 sequence region. In one embodiment, the filler sequence region is the FILL5 sequence region, the FILL6 sequence region, and the FILL9 sequence region. In one embodiment, the filler sequence region is the FILL5 sequence region, the FILL6 sequence region, and the FILL10 sequence region. In one embodiment, the filler sequence region is the FILL5 sequence region, the FILL6 sequence region, and the FILL11 sequence region. In one embodiment, the filler sequence region is the FILL5 sequence region, the FILL6 sequence region, and the FILL12 sequence region. In one embodiment, the filler sequence region is the FILL5 sequence region, the FILL6 sequence region, and the FILL13 sequence region. In one embodiment, the filler sequence region is the FILL5 sequence region, the FILL6 sequence region, and the FILL14 sequence region. In one embodiment, the filler sequence region is the FILL5 sequence region, the FILL6 sequence region, and the FILL15 sequence region. In one embodiment, the filler sequence region is the FILL5 sequence region, the FILL6 sequence region, and the FILL16 sequence region. In one embodiment, the filler sequence region is the FILL5 sequence region, the FILL6 sequence region, and the FILL17 sequence region. In one embodiment, the filler sequence region is the FILL5 sequence region, the FILL6 sequence region, and the FILL18 sequence region. In one embodiment, the filler sequence region is the FILL5 sequence region, the FILL7 sequence region, and the FILL8 sequence region. In one embodiment, the filler sequence region is the FILL5 sequence region, the FILL7 sequence region, and the FILL9 sequence region. In one embodiment, the filler sequence region is the FILL5 sequence region, the FILL7 sequence region, and the FILL10 sequence region. In one embodiment, the filler sequence region is the FILL5 sequence region, the FILL7 sequence region, and the FILL11 sequence region. In one embodiment, the filler sequence region is the FILL5 sequence region, the FILL7 sequence region, and the FILL12 sequence region. In one embodiment, the filler sequence region is the FILL5 sequence region, the FILL7 sequence region, and the FILL13 sequence region. In one embodiment, the filler sequence region is the FILL5 sequence region, the FILL7 sequence region, and the FILL14 sequence region. In one embodiment, the filler sequence region is the FILL5 sequence region, the FILL7 sequence region, and the FILL15 sequence region. In one embodiment, the filler sequence region is the FILL5 sequence region, the FILL7 sequence region, and the FILL16 sequence region. In one embodiment, the filler sequence region is the FILL5 sequence region, the FILL7 sequence region, and the FILL17 sequence region. In one embodiment, the filler sequence region is the FILL5 sequence region, the FILL7 sequence region, and the FILL18 sequence region. In one embodiment, the filler sequence region is the FILL5 sequence region, the FILL5 sequence region, and the FILL9 sequence region. In one embodiment, the filler sequence region is the FILL5 sequence region, the FILL8 sequence region, and the FILL10 sequence region. In one embodiment, the filler sequence region is the FILL5 sequence region, the FILL5 sequence region, and the FILL11 sequence region. In one embodiment, the filler sequence region is the FILL5 sequence region, the FILL5 sequence region, and the FILL12 sequence region. In one embodiment, the filler sequence region is the FILL5 sequence region, the FILL8 sequence region, and the FILL13 sequence region. In one embodiment, the filler sequence region is the FILL5 sequence region, the FILL8 sequence region, and the FILL14 sequence region. In one embodiment, the filler sequence region is the FILL5 sequence region, the FILL5 sequence region, and the FILL15 sequence region. In one embodiment, the filler sequence region is the FILL5 sequence region, the FILL8 sequence region, and the FILL16 sequence region. In one embodiment, the filler sequence region is the FILL5 sequence region, the FILL5 sequence region, and the FILL17 sequence region. In one embodiment, the filler sequence region is the FILL5 sequence region, the FILL5 sequence region, and the FILL18 sequence region. In one embodiment, the filler sequence region is the FILL5 sequence region, the FILL9 sequence region, and the FILL10 sequence region. In one embodiment, the filler sequence region is the FILL5 sequence region, the FILL9 sequence region, and the FILL11 sequence region. In one embodiment, the filler sequence region is the FILL5 sequence region, the FILL9 sequence region, and the FILL12 sequence region. In one embodiment, the filler sequence region is the FILL5 sequence region, the FILL9 sequence region, and the FILL13 sequence region. In one embodiment, the filler sequence region is the FILL5 sequence region, the FILL9 sequence region, and the FILL14 sequence region. In one embodiment, the filler sequence region is the FILL5 sequence region, the FILL9 sequence region, and the FILL15 sequence region. In one embodiment, the filler sequence region is the FILL5 sequence region, the FILL9 sequence region, and the FILL16 sequence region. In one embodiment, the filler sequence region is the FILL5 sequence region, the FILL9 sequence region, and the FILL17 sequence region. In one embodiment, the filler sequence region is the FILL5 sequence region, the FILL9 sequence region, and the FILL18 sequence region. In one embodiment, the filler sequence region is the FILL5 sequence region, the FILL10 sequence region, and the FILL11 sequence region. In one embodiment, the filler sequence region is the FILL5 sequence region, the FILL10 sequence region, and the FILL12 sequence region. In one embodiment, the filler sequence region is the FILL5 sequence region, the FILL10 sequence region, and the FILL13 sequence region. In one embodiment, the filler sequence region is the FILL5 sequence region, the FILL10 sequence region, and the FILL14 sequence region. In one embodiment, the filler sequence region is the FILL5 sequence region, the FILL10 sequence region, and the FILL15 sequence region. In one embodiment, the filler sequence region is the FILL5 sequence region, the FILL10 sequence region, and the FILL16 sequence region. In one embodiment, the filler sequence region is the FILL5 sequence region, the FILL10 sequence region, and the FILL17 sequence region. In one embodiment, the filler sequence region is the FILL5 sequence region, the FILL10 sequence region, and the FILL18 sequence region. In one embodiment, the filler sequence region is the FILL5 sequence region, the FILL11 sequence region, and the FILL12 sequence region. In one embodiment, the filler sequence region is the FILL5 sequence region, the FILL11 sequence region, and the FILL13 sequence region. In one embodiment, the filler sequence region is the FILL5 sequence region, the FILL11 sequence region, and the FILL14 sequence region. In one embodiment, the filler sequence region is the FILL5 sequence region, the FILL11 sequence region, and the FILL15 sequence region. In one embodiment, the filler sequence region is the FILL5 sequence region, the FILL11 sequence region, and the FILL16 sequence region. In one embodiment, the filler sequence region is the FILL5 sequence region, the FILL11 sequence region, and the FILL17 sequence region. In one embodiment, the filler sequence region is the FILL5 sequence region, the FILL11 sequence region, and the FILL18 sequence region. In one embodiment, the filler sequence region is the FILL5 sequence region, the FILL12 sequence region, and the FILL13 sequence region. In one embodiment, the filler sequence region is the FILL5 sequence region, the FILL12 sequence region, and the FILL14 sequence region. In one embodiment, the filler sequence region is the FILL5 sequence region, the FILL12 sequence region, and the FILL15 sequence region. In one embodiment, the filler sequence region is the FILL5 sequence region, the FILL12 sequence region, and the FILL16 sequence region. In one embodiment, the filler sequence region is the FILL5 sequence region, the FILL12 sequence region, and the FILL17 sequence region. In one embodiment, the filler sequence region is the FILL5 sequence region, the FILL12 sequence region, and the FILL18 sequence region. In one embodiment, the filler sequence region is the FILL5 sequence region, the FILL13 sequence region, and the FILL14 sequence region. In one embodiment, the filler sequence region is the FILL5 sequence region, the FILL13 sequence region, and the FILL15 sequence region. In one embodiment, the filler sequence region is the FILL5 sequence region, the FILL13 sequence region, and the FILL16 sequence region. In one embodiment, the filler sequence region is the FILL5 sequence region, the FILL13 sequence region, and the FILL17 sequence region. In one embodiment, the filler sequence region is the FILL5 sequence region, the FILL13 sequence region, and the FILL18 sequence region. In one embodiment, the filler sequence region is the FILL5 sequence region, the FILL14 sequence region, and the FILL15 sequence region. In one embodiment, the filler sequence region is the FILL5 sequence region, the FILL14 sequence region, and the FILL16 sequence region. In one embodiment, the filler sequence region is the FILL5 sequence region, the FILL14 sequence region, and the FILL17 sequence region. In one embodiment, the filler sequence region is the FILL5 sequence region, the FILL14 sequence region, and the FILL18 sequence region. In one embodiment, the filler sequence region is the FILL5 sequence region, the FILL15 sequence region, and the FILL16 sequence region. In one embodiment, the filler sequence region is the FILL5 sequence region, the FILL15 sequence region, and the FILL17 sequence region. In one embodiment, the filler sequence region is the FILL5 sequence region, the FILL15 sequence region, and the FILL18 sequence region. In one embodiment, the filler sequence region is the FILL5 sequence region, the FILL16 sequence region, and the FILL17 sequence region. In one embodiment, the filler sequence region is the FILL5 sequence region, the FILL16 sequence region, and the FILL18 sequence region. In one embodiment, the filler sequence region is the FILL5 sequence region, the FILL17 sequence region, and the FILL18 sequence region. In one embodiment, the filler sequence region is the FILL6 sequence region, the FILL7 sequence region, and the FILL8 sequence region. In one embodiment, the filler sequence region is the FILL6 sequence region, the FILL7 sequence region, and the FILL9 sequence region. In one embodiment, the filler sequence region is the FILL6 sequence region, the FILL7 sequence region, and the FILL10 sequence region. In one embodiment, the filler sequence region is the FILL6 sequence region, the FILL7 sequence region, and the FILL11 sequence region. In one embodiment, the filler sequence region is the FILL6 sequence region, the FILL7 sequence region, and the FILL12 sequence region. In one embodiment, the filler sequence region is the FILL6 sequence region, the FILL7 sequence region, and the FILL13 sequence region. In one embodiment, the filler sequence region is the FILL6 sequence region, the FILL7 sequence region, and the FILL14 sequence region. In one embodiment, the filler sequence region is the FILL6 sequence region, the FILL7 sequence region, and the FILL15 sequence region. In one embodiment, the filler sequence region is the FILL6 sequence region, the FILL7 sequence region, and the FILL16 sequence region. In one embodiment, the filler sequence region is the FILL6 sequence region, the FILL7 sequence region, and the FILL17 sequence region. In one embodiment, the filler sequence region is the FILL6 sequence region, the FILL7 sequence region, and the FILL18 sequence region. In one embodiment, the filler sequence region is the FILL6 sequence region, the FILL8 sequence region, and the FILL9 sequence region. In one embodiment, the filler sequence region is the FILL6 sequence region, the FILL8 sequence region, and the FILL10 sequence region. In one embodiment, the filler sequence region is the FILL6 sequence region, the FILL5 sequence region, and the FILL11 sequence region. In one embodiment, the filler sequence region is the FILL6 sequence region, the FILL8 sequence region, and the FILL12 sequence region. In one embodiment, the filler sequence region is the FILL6 sequence region, the FILL8 sequence region, and the FILL13 sequence region. In one embodiment, the filler sequence region is the FILL6 sequence region, the FILL8 sequence region, and the FILL14 sequence region. In one embodiment, the filler sequence region is the FILL6 sequence region, the FILL8 sequence region, and the FILL15 sequence region. In one embodiment, the filler sequence region is the FILL6 sequence region, the FILL8 sequence region, and the FILL16 sequence region. In one embodiment, the filler sequence region is the FILL6 sequence region, the FILL8 sequence region, and the FILL17 sequence region. In one embodiment, the filler sequence region is the FILL6 sequence region, the FILL8 sequence region, and the FILL18 sequence region. In one embodiment, the filler sequence region is the FILL6 sequence region, the FILL9 sequence region, and the FILL10 sequence region. In one embodiment, the filler sequence region is the FILL6 sequence region, the FILL9 sequence region, and the FILL11 sequence region. In one embodiment, the filler sequence region is the FILL6 sequence region, the FILL9 sequence region, and the FILL12 sequence region. In one embodiment, the filler sequence region is the FILL6 sequence region, the FILL9 sequence region, and the FILL13 sequence region. In one embodiment, the filler sequence region is the FILL6 sequence region, the FILL9 sequence region, and the FILL14 sequence region. In one embodiment, the filler sequence region is the FILL6 sequence region, the FILL9 sequence region, and the FILL15 sequence region. In one embodiment, the filler sequence region is the FILL6 sequence region, the FILL9 sequence region, and the FILL16 sequence region. In one embodiment, the filler sequence region is the FILL6 sequence region, the FILL9 sequence region, and the FILL17 sequence region. In one embodiment, the filler sequence region is the FILL6 sequence region, the FILL9 sequence region, and the FILL18 sequence region. In one embodiment, the filler sequence region is the FILL6 sequence region, the FILL10 sequence region, and the FILL11 sequence region. In one embodiment, the filler sequence region is the FILL6 sequence region, the FILL10 sequence region, and the FILL12 sequence region. In one embodiment, the filler sequence region is the FILL6 sequence region, the FILL10 sequence region, and the FILL13 sequence region. In one embodiment, the filler sequence region is the FILL6 sequence region, the FILL10 sequence region, and the FILL14 sequence region. In one embodiment, the filler sequence region is the FILL6 sequence region, the FILL10 sequence region, and the FILL15 sequence region. In one embodiment, the filler sequence region is the FILL6 sequence region, the FILL10 sequence region, and the FILL16 sequence region. In one embodiment, the filler sequence region is the FILL6 sequence region, the FILL10 sequence region, and the FILL17 sequence region. In one embodiment, the filler sequence region is the FILL6 sequence region, the FILL10 sequence region, and the FILL18 sequence region. In one embodiment, the filler sequence region is the FILL6 sequence region, the FILL11 sequence region, and the FILL12 sequence region. In one embodiment, the filler sequence region is the FILL6 sequence region, the FILL11 sequence region, and the FILL13 sequence region. In one embodiment, the filler sequence region is the FILL6 sequence region, the FILL11 sequence region, and the FILL14 sequence region. In one embodiment, the filler sequence region is the FILL6 sequence region, the FILL11 sequence region, and the FILL15 sequence region. In one embodiment, the filler sequence region is the FILL6 sequence region, the FILL11 sequence region, and the FILL16 sequence region. In one embodiment, the filler sequence region is the FILL6 sequence region, the FILL11 sequence region, and the FILL17 sequence region. In one embodiment, the filler sequence region is the FILL6 sequence region, the FILL11 sequence region, and the FILL18 sequence region. In one embodiment, the filler sequence region is the FILL6 sequence region, the FILL12 sequence region, and the FILL13 sequence region. In one embodiment, the filler sequence region is the FILL6 sequence region, the FILL12 sequence region, and the FILL14 sequence region. In one embodiment, the filler sequence region is the FILL6 sequence region, the FILL12 sequence region, and the FILL15 sequence region. In one embodiment, the filler sequence region is the FILL6 sequence region, the FILL12 sequence region, and the FILL16 sequence region. In one embodiment, the filler sequence region is the FILL6 sequence region, the FILL12 sequence region, and the FILL17 sequence region. In one embodiment, the filler sequence region is the FILL6 sequence region, the FILL12 sequence region, and the FILL18 sequence region. In one embodiment, the filler sequence region is the FILL6 sequence region, the FILL13 sequence region, and the FILL14 sequence region. In one embodiment, the filler sequence region is the FILL6 sequence region, the FILL13 sequence region, and the FILL15 sequence region. In one embodiment, the filler sequence region is the FILL6 sequence region, the FILL13 sequence region, and the FILL16 sequence region. In one embodiment, the filler sequence region is the FILL6 sequence region, the FILL13 sequence region, and the FILL17 sequence region. In one embodiment, the filler sequence region is the FILL6 sequence region, the FILL13 sequence region, and the FILL18 sequence region. In one embodiment, the filler sequence region is the FILL6 sequence region, the FILL14 sequence region, and the FILL15 sequence region. In one embodiment, the filler sequence region is the FILL6 sequence region, the FILL14 sequence region, and the FILL16 sequence region. In one embodiment, the filler sequence region is the FILL6 sequence region, the FILL14 sequence region, and the FILL17 sequence region. In one embodiment, the filler sequence region is the FILL6 sequence region, the FILL14 sequence region, and the FILL18 sequence region. In one embodiment, the filler sequence region is the FILL6 sequence region, the FILL15 sequence region, and the FILL16 sequence region. In one embodiment, the filler sequence region is the FILL6 sequence region, the FILL15 sequence region, and the FILL17 sequence region. In one embodiment, the filler sequence region is the FILL6 sequence region, the FILL15 sequence region, and the FILL18 sequence region. In one embodiment, the filler sequence region is the FILL6 sequence region, the FILL16 sequence region, and the FILL17 sequence region. In one embodiment, the filler sequence region is the FILL6 sequence region, the FILL16 sequence region, and the FILL18 sequence region. In one embodiment, the filler sequence region is the FILL6 sequence region, the FILL17 sequence region, and the FILL18 sequence region. In one embodiment, the filler sequence region is the FILL7 sequence region, the FILL8 sequence region, and the FILL9 sequence region. In one embodiment, the filler sequence region is the FILL7 sequence region, the FILL8 sequence region, and the FILL10 sequence region. In one embodiment, the filler sequence region is the FILL7 sequence region, the FILL8 sequence region, and the FILL11 sequence region. In one embodiment, the filler sequence region is the FILL7 sequence region, the FILL8 sequence region, and the FILL12 sequence region. In one embodiment, the filler sequence region is the FILL7 sequence region, the FILL8 sequence region, and the FILL13 sequence region. In one embodiment, the filler sequence region is the FILL7 sequence region, the FILL8 sequence region, and the FILL14 sequence region. In one embodiment, the filler sequence region is the FILL7 sequence region, the FILL8 sequence region, and the FILL15 sequence region. In one embodiment, the filler sequence region is the FILL7 sequence region, the FILL8 sequence region, and the FILL16 sequence region. In one embodiment, the filler sequence region is the FILL7 sequence region, the FILL8 sequence region, and the FILL17 sequence region. In one embodiment, the filler sequence region is the FILL7 sequence region, the FILL8 sequence region, and the FILL18 sequence region. In one embodiment, the filler sequence region is the FILL7 sequence region, the FILL9 sequence region, and the FILL10 sequence region. In one embodiment, the filler sequence region is the FILL7 sequence region, the FILL9 sequence region, and the FILL11 sequence region. In one embodiment, the filler sequence region is the FILL7 sequence region, the FILL9 sequence region, and the FILL12 sequence region. In one embodiment, the filler sequence region is the FILL7 sequence region, the FILL9 sequence region, and the FILL13 sequence region. In one embodiment, the filler sequence region is the FILL7 sequence region, the FILL9 sequence region, and the FILL14 sequence region. In one embodiment, the filler sequence region is the FILL7 sequence region, the FILL9 sequence region, and the FILL15 sequence region. In one embodiment, the filler sequence region is the FILL7 sequence region, the FILL9 sequence region, and the FILL16 sequence region. In one embodiment, the filler sequence region is the FILL7 sequence region, the FILL9 sequence region, and the FILL17 sequence region. In one embodiment, the filler sequence region is the FILL7 sequence region, the FILL9 sequence region, and the FILL18 sequence region. In one embodiment, the filler sequence region is the FILL7 sequence region, the FILL10 sequence region, and the FILL11 sequence region. In one embodiment, the filler sequence region is the FILL7 sequence region, the FILL10 sequence region, and the FILL12 sequence region. In one embodiment, the filler sequence region is the FILL7 sequence region, the FILL10 sequence region, and the FILL13 sequence region. In one embodiment, the filler sequence region is the FILL7 sequence region, the FILL10 sequence region, and the FILL14 sequence region. In one embodiment, the filler sequence region is the FILL7 sequence region, the FILL10 sequence region, and the FILL15 sequence region. In one embodiment, the filler sequence region is the FILL7 sequence region, the FILL10 sequence region, and the FILL16 sequence region. In one embodiment, the filler sequence region is the FILL7 sequence region, the FILL10 sequence region, and the FILL17 sequence region. In one embodiment, the filler sequence region is the FILL7 sequence region, the FILL10 sequence region, and the FILL18 sequence region. In one embodiment, the filler sequence region is the FILL7 sequence region, the FILL11 sequence region, and the FILL12 sequence region. In one embodiment, the filler sequence region is the FILL7 sequence region, the FILL11 sequence region, and the FILL13 sequence region. In one embodiment, the filler sequence region is the FILL7 sequence region, the FILL11 sequence region, and the FILL14 sequence region. In one embodiment, the filler sequence region is the FILL7 sequence region, the FILL11 sequence region, and the FILL15 sequence region. In one embodiment, the filler sequence region is the FILL7 sequence region, the FILL11 sequence region, and the FILL16 sequence region. In one embodiment, the filler sequence region is the FILL7 sequence region, the FILL11 sequence region, and the FILL17 sequence region. In one embodiment, the filler sequence region is the FILL7 sequence region, the FILL11 sequence region, and the FILL18 sequence region. In one embodiment, the filler sequence region is the FILL7 sequence region, the FILL12 sequence region, and the FILL13 sequence region. In one embodiment, the filler sequence region is the FILL7 sequence region, the FILL12 sequence region, and the FILL14 sequence region. In one embodiment, the filler sequence region is the FILL7 sequence region, the FILL12 sequence region, and the FILL15 sequence region. In one embodiment, the filler sequence region is the FILL7 sequence region, the FILL12 sequence region, and the FILL16 sequence region. In one embodiment, the filler sequence region is the FILL7 sequence region, the FILL12 sequence region, and the FILL17 sequence region. In one embodiment, the filler sequence region is the FILL7 sequence region, the FILL12 sequence region, and the FILL18 sequence region. In one embodiment, the filler sequence region is the FILL7 sequence region, the FILL13 sequence region, and the FILL14 sequence region. In one embodiment, the filler sequence region is the FILL7 sequence region, the FILL13 sequence region, and the FILL15 sequence region. In one embodiment, the filler sequence region is the FILL7 sequence region, the FILL13 sequence region, and the FILL16 sequence region. In one embodiment, the filler sequence region is the FILL7 sequence region, the FILL13 sequence region, and the FILL17 sequence region. In one embodiment, the filler sequence region is the FILL7 sequence region, the FILL13 sequence region, and the FILL18 sequence region. In one embodiment, the filler sequence region is the FILL7 sequence region, the FILL14 sequence region, and the FILL15 sequence region. In one embodiment, the filler sequence region is the FILL7 sequence region, the FILL14 sequence region, and the FILL16 sequence region. In one embodiment, the filler sequence region is the FILL7 sequence region, the FILL14 sequence region, and the FILL17 sequence region. In one embodiment, the filler sequence region is the FILL7 sequence region, the FILL14 sequence region, and the FILL18 sequence region. In one embodiment, the filler sequence region is the FILL7 sequence region, the FILL15 sequence region, and the FILL16 sequence region. In one embodiment, the filler sequence region is the FILL7 sequence region, the FILL15 sequence region, and the FILL17 sequence region. In one embodiment, the filler sequence region is the FILL7 sequence region, the FILL15 sequence region, and the FILL18 sequence region. In one embodiment, the filler sequence region is the FILL7 sequence region, the FILL16 sequence region, and the FILL17 sequence region. In one embodiment, the filler sequence region is the FILL7 sequence region, the FILL16 sequence region, and the FILL18 sequence region. In one embodiment, the filler sequence region is the FILL7 sequence region, the FILL17 sequence region, and the FILL18 sequence region. In one embodiment, the filler sequence region is the FILL8 sequence region, the FILL9 sequence region, and the FILL10 sequence region. In one embodiment, the filler sequence region is the FILL5 sequence region, the FILL9 sequence region, and the FILL11 sequence region. In one embodiment, the filler sequence region is the FILL5 sequence region, the FILL9 sequence region, and the FILL12 sequence region. In one embodiment, the filler sequence region is the FILL8 sequence region, the FILL9 sequence region, and the FILL13 sequence region. In one embodiment, the filler sequence region is the FILL8 sequence region, the FILL9 sequence region, and the FILL14 sequence region. In one embodiment, the filler sequence region is the FILL8 sequence region, the FILL9 sequence region, and the FILL15 sequence region. In one embodiment, the filler sequence region is the FILL8 sequence region, the FILL9 sequence region, and the FILL16 sequence region. In one embodiment, the filler sequence region is the FILL8 sequence region, the FILL9 sequence region, and the FILL17 sequence region. In one embodiment, the filler sequence region is the FILL8 sequence region, the FILL9 sequence region, and the FILL18 sequence region. In one embodiment, the filler sequence region is the FILL8 sequence region, the FILL10 sequence region, and the FILL11 sequence region. In one embodiment, the filler sequence region is the FILL8 sequence region, the FILL10 sequence region, and the FILL12 sequence region. In one embodiment, the filler sequence region is the FILL8 sequence region, the FILL10 sequence region, and the FILL13 sequence region. In one embodiment, the filler sequence region is the FILL8 sequence region, the FILL10 sequence region, and the FILL14 sequence region. In one embodiment, the filler sequence region is the FILL8 sequence region, the FILL10 sequence region, and the FILL15 sequence region. In one embodiment, the filler sequence region is the FILL8 sequence region, the FILL10 sequence region, and the FILL16 sequence region. In one embodiment, the filler sequence region is the FILL8 sequence region, the FILL10 sequence region, and the FILL17 sequence region. In one embodiment, the filler sequence region is the FILL5 sequence region, the FILL10 sequence region, and the FILL18 sequence region. In one embodiment, the filler sequence region is the FILL8 sequence region, the FILL11 sequence region, and the FILL12 sequence region. In one embodiment, the filler sequence region is the FILL8 sequence region, the FILL11 sequence region, and the FILL13 sequence region. In one embodiment, the filler sequence region is the FILL8 sequence region, the FILL11 sequence region, and the FILL14 sequence region. In one embodiment, the filler sequence region is the FILL8 sequence region, the FILL11 sequence region, and the FILL15 sequence region. In one embodiment, the filler sequence region is the FILL8 sequence region, the FILL11 sequence region, and the FILL16 sequence region. In one embodiment, the filler sequence region is the FILL8 sequence region, the FILL11 sequence region, and the FILL17 sequence region. In one embodiment, the filler sequence region is the FILL8 sequence region, the FILL11 sequence region, and the FILL18 sequence region. In one embodiment, the filler sequence region is the FILL8 sequence region, the FILL12 sequence region, and the FILL13 sequence region. In one embodiment, the filler sequence region is the FILL8 sequence region, the FILL12 sequence region, and the FILL14 sequence region. In one embodiment, the filler sequence region is the FILL8 sequence region, the FILL12 sequence region, and the FILL15 sequence region. In one embodiment, the filler sequence region is the FILL8 sequence region, the FILL12 sequence region, and the FILL16 sequence region. In one embodiment, the filler sequence region is the FILL8 sequence region, the FILL12 sequence region, and the FILL17 sequence region. In one embodiment, the filler sequence region is the FILL8 sequence region, the FILL12 sequence region, and the FILL18 sequence region. In one embodiment, the filler sequence region is the FILL8 sequence region, the FILL13 sequence region, and the FILL14 sequence region. In one embodiment, the filler sequence region is the FILL8 sequence region, the FILL13 sequence region, and the FILL15 sequence region. In one embodiment, the filler sequence region is the FILL8 sequence region, the FILL13 sequence region, and the FILL16 sequence region. In one embodiment, the filler sequence region is the FILL8 sequence region, the FILL13 sequence region, and the FILL17 sequence region. In one embodiment, the filler sequence region is the FILL8 sequence region, the FILL13 sequence region, and the FILL18 sequence region. In one embodiment, the filler sequence region is the FILL8 sequence region, the FILL14 sequence region, and the FILL15 sequence region. In one embodiment, the filler sequence region is the FILL8 sequence region, the FILL14 sequence region, and the FILL16 sequence region. In one embodiment, the filler sequence region is the FILL8 sequence region, the FILL14 sequence region, and the FILL17 sequence region. In one embodiment, the filler sequence region is the FILL8 sequence region, the FILL14 sequence region, and the FILL18 sequence region. In one embodiment, the filler sequence region is the FILL8 sequence region, the FILL15 sequence region, and the FILL16 sequence region. In one embodiment, the filler sequence region is the FILL8 sequence region, the FILL15 sequence region, and the FILL17 sequence region. In one embodiment, the filler sequence region is the FILL8 sequence region, the FILL15 sequence region, and the FILL18 sequence region. In one embodiment, the filler sequence region is the FILL8 sequence region, the FILL16 sequence region, and the FILL17 sequence region. In one embodiment, the filler sequence region is the FILL8 sequence region, the FILL16 sequence region, and the FILL18 sequence region. In one embodiment, the filler sequence region is the FILL8 sequence region, the FILL17 sequence region, and the FILL18 sequence region. In one embodiment, the filler sequence region is the FILL9 sequence region, the FILL10 sequence region, and the FILL11 sequence region. In one embodiment, the filler sequence region is the FILL9 sequence region, the FILL10 sequence region, and the FILL12 sequence region. In one embodiment, the filler sequence region is the FILL9 sequence region, the FILL10 sequence region, and the FILL13 sequence region. In one embodiment, the filler sequence region is the FILL9 sequence region, the FILL10 sequence region, and the FILL14 sequence region. In one embodiment, the filler sequence region is the FILL9 sequence region, the FILL10 sequence region, and the FILL15 sequence region. In one embodiment, the filler sequence region is the FILL9 sequence region, the FILL10 sequence region, and the FILL16 sequence region. In one embodiment, the filler sequence region is the FILL9 sequence region, the FILL10 sequence region, and the FILL17 sequence region. In one embodiment, the filler sequence region is the FILL9 sequence region, the FILL10 sequence region, and the FILL18 sequence region. In one embodiment, the filler sequence region is the FILL9 sequence region, the FILL11 sequence region, and the FILL12 sequence region. In one embodiment, the filler sequence region is the FILL9 sequence region, the FILL11 sequence region, and the FILL13 sequence region. In one embodiment, the filler sequence region is the FILL9 sequence region, the FILL11 sequence region, and the FILL14 sequence region. In one embodiment, the filler sequence region is the FILL9 sequence region, the FILL11 sequence region, and the FILL15 sequence region. In one embodiment, the filler sequence region is the FILL9 sequence region, the FILL11 sequence region, and the FILL16 sequence region. In one embodiment, the filler sequence region is the FILL9 sequence region, the FILL11 sequence region, and the FILL17 sequence region. In one embodiment, the filler sequence region is the FILL9 sequence region, the FILL11 sequence region, and the FILL18 sequence region. In one embodiment, the filler sequence region is the FILL9 sequence region, the FILL12 sequence region, and the FILL13 sequence region. In one embodiment, the filler sequence region is the FILL9 sequence region, the FILL12 sequence region, and the FILL14 sequence region. In one embodiment, the filler sequence region is the FILL9 sequence region, the FILL12 sequence region, and the FILL15 sequence region. In one embodiment, the filler sequence region is the FILL9 sequence region, the FILL12 sequence region, and the FILL16 sequence region. In one embodiment, the filler sequence region is the FILL9 sequence region, the FILL12 sequence region, and the FILL17 sequence region. In one embodiment, the filler sequence region is the FILL9 sequence region, the FILL12 sequence region, and the FILL18 sequence region. In one embodiment, the filler sequence region is the FILL9 sequence region, the FILL13 sequence region, and the FILL14 sequence region. In one embodiment, the filler sequence region is the FILL9 sequence region, the FILL13 sequence region, and the FILL15 sequence region. In one embodiment, the filler sequence region is the FILL9 sequence region, the FILL13 sequence region, and the FILL16 sequence region. In one embodiment, the filler sequence region is the FILL9 sequence region, the FILL13 sequence region, and the FILL17 sequence region. In one embodiment, the filler sequence region is the FILL9 sequence region, the FILL13 sequence region, and the FILL18 sequence region. In one embodiment, the filler sequence region is the FILL9 sequence region, the FILL14 sequence region, and the FILL15 sequence region. In one embodiment, the filler sequence region is the FILL9 sequence region, the FILL14 sequence region, and the FILL16 sequence region. In one embodiment, the filler sequence region is the FILL9 sequence region, the FILL14 sequence region, and the FILL17 sequence region. In one embodiment, the filler sequence region is the FILL9 sequence region, the FILL14 sequence region, and the FILL18 sequence region. In one embodiment, the filler sequence region is the FILL9 sequence region, the FILL15 sequence region, and the FILL16 sequence region. In one embodiment, the filler sequence region is the FILL9 sequence region, the FILL15 sequence region, and the FILL17 sequence region. In one embodiment, the filler sequence region is the FILL9 sequence region, the FILL15 sequence region, and the FILL18 sequence region. In one embodiment, the filler sequence region is the FILL9 sequence region, the FILL16 sequence region, and the FILL17 sequence region. In one embodiment, the filler sequence region is the FILL9 sequence region, the FILL16 sequence region, and the FILL18 sequence region. In one embodiment, the filler sequence region is the FILL9 sequence region, the FILL17 sequence region, and the FILL18 sequence region. In one embodiment, the filler sequence region is the FILL10 sequence region, the FILL11 sequence region, and the FILL12 sequence region. In one embodiment, the filler sequence region is the FILL10 sequence region, the FILL11 sequence region, and the FILL13 sequence region. In one embodiment, the filler sequence region is the FILL10 sequence region, the FILL11 sequence region, and the FILL14 sequence region. In one embodiment, the filler sequence region is the FILL10 sequence region, the FILL11 sequence region, and the FILL15 sequence region. In one embodiment, the filler sequence region is the FILL10 sequence region, the FILL11 sequence region, and the FILL16 sequence region. In one embodiment, the filler sequence region is the FILL10 sequence region, the FILL11 sequence region, and the FILL17 sequence region. In one embodiment, the filler sequence region is the FILL10 sequence region, the FILL11 sequence region, and the FILL18 sequence region. In one embodiment, the filler sequence region is the FILL10 sequence region, the FILL12 sequence region, and the FILL13 sequence region. In one embodiment, the filler sequence region is the FILL10 sequence region, the FILL12 sequence region, and the FILL14 sequence region. In one embodiment, the filler sequence region is the FILL10 sequence region, the FILL12 sequence region, and the FILL15 sequence region. In one embodiment, the filler sequence region is the FILL10 sequence region, the FILL12 sequence region, and the FILL16 sequence region. In one embodiment, the filler sequence region is the FILL10 sequence region, the FILL12 sequence region, and the FILL17 sequence region. In one embodiment, the filler sequence region is the FILL10 sequence region, the FILL12 sequence region, and the FILL18 sequence region. In one embodiment, the filler sequence region is the FILL10 sequence region, the FILL13 sequence region, and the FILL14 sequence region. In one embodiment, the filler sequence region is the FILL10 sequence region, the FILL13 sequence region, and the FILL15 sequence region. In one embodiment, the filler sequence region is the FILL10 sequence region, the FILL13 sequence region, and the FILL16 sequence region. In one embodiment, the filler sequence region is the FILL10 sequence region, the FILL13 sequence region, and the FILL17 sequence region. In one embodiment, the filler sequence region is the FILL10 sequence region, the FILL13 sequence region, and the FILL18 sequence region. In one embodiment, the filler sequence region is the FILL10 sequence region, the FILL14 sequence region, and the FILL15 sequence region. In one embodiment, the filler sequence region is the FILL10 sequence region, the FILL14 sequence region, and the FILL16 sequence region. In one embodiment, the filler sequence region is the FILL10 sequence region, the FILL14 sequence region, and the FILL17 sequence region. In one embodiment, the filler sequence region is the FILL10 sequence region, the FILL14 sequence region, and the FILL18 sequence region. In one embodiment, the filler sequence region is the FILL10 sequence region, the FILL15 sequence region, and the FILL16 sequence region. In one embodiment, the filler sequence region is the FILL10 sequence region, the FILL15 sequence region, and the FILL17 sequence region. In one embodiment, the filler sequence region is the FILL10 sequence region, the FILL15 sequence region, and the FILL18 sequence region. In one embodiment, the filler sequence region is the FILL10 sequence region, the FILL16 sequence region, and the FILL17 sequence region. In one embodiment, the filler sequence region is the FILL10 sequence region, the FILL16 sequence region, and the FILL18 sequence region. In one embodiment, the filler sequence region is the FILL10 sequence region, the FILL17 sequence region, and the FILL18 sequence region. In one embodiment, the filler sequence region is the FILL11 sequence region, the FILL12 sequence region, and the FILL13 sequence region. In one embodiment, the filler sequence region is the FILL11 sequence region, the FILL12 sequence region, and the FILL14 sequence region. In one embodiment, the filler sequence region is the FILL11 sequence region, the FILL12 sequence region, and the FILL15 sequence region. In one embodiment, the filler sequence region is the FILL11 sequence region, the FILL12 sequence region, and the FILL16 sequence region. In one embodiment, the filler sequence region is the FILL11 sequence region, the FILL12 sequence region, and the FILL17 sequence region. In one embodiment, the filler sequence region is the FILL11 sequence region, the FILL12 sequence region, and the FILL18 sequence region. In one embodiment, the filler sequence region is the FILL11 sequence region, the FILL13 sequence region, and the FILL14 sequence region. In one embodiment, the filler sequence region is the FILL11 sequence region, the FILL13 sequence region, and the FILL15 sequence region. In one embodiment, the filler sequence region is the FILL11 sequence region, the FILL13 sequence region, and the FILL16 sequence region. In one embodiment, the filler sequence region is the FILL11 sequence region, the FILL13 sequence region, and the FILL17 sequence region. In one embodiment, the filler sequence region is the FILL11 sequence region, the FILL13 sequence region, and the FILL18 sequence region. In one embodiment, the filler sequence region is the FILL11 sequence region, the FILL14 sequence region, and the FILL15 sequence region. In one embodiment, the filler sequence region is the FILL11 sequence region, the FILL14 sequence region, and the FILL16 sequence region. In one embodiment, the filler sequence region is the FILL11 sequence region, the FILL14 sequence region, and the FILL17 sequence region. In one embodiment, the filler sequence region is the FILL11 sequence region, the FILL14 sequence region, and the FILL18 sequence region. In one embodiment, the filler sequence region is the FILL11 sequence region, the FILL15 sequence region, and the FILL16 sequence region. In one embodiment, the filler sequence region is the FILL11 sequence region, the FILL15 sequence region, and the FILL17 sequence region. In one embodiment, the filler sequence region is the FILL11 sequence region, the FILL15 sequence region, and the FILL18 sequence region. In one embodiment, the filler sequence region is the FILL11 sequence region, the FILL16 sequence region, and the FILL17 sequence region. In one embodiment, the filler sequence region is the FILL11 sequence region, the FILL16 sequence region, and the FILL18 sequence region. In one embodiment, the filler sequence region is the FILL11 sequence region, the FILL17 sequence region, and the FILL18 sequence region. In one embodiment, the filler sequence region is the FILL12 sequence region, the FILL13 sequence region, and the FILL14 sequence region. In one embodiment, the filler sequence region is the FILL12 sequence region, the FILL13 sequence region, and the FILL15 sequence region. In one embodiment, the filler sequence region is the FILL12 sequence region, the FILL13 sequence region, and the FILL16 sequence region. In one embodiment, the filler sequence region is the FILL12 sequence region, the FILL13 sequence region, and the FILL17 sequence region. In one embodiment, the filler sequence region is the FILL12 sequence region, the FILL13 sequence region, and the FILL18 sequence region. In one embodiment, the filler sequence region is the FILL12 sequence region, the FILL14 sequence region, and the FILL15 sequence region. In one embodiment, the filler sequence region is the FILL12 sequence region, the FILL14 sequence region, and the FILL16 sequence region. In one embodiment, the filler sequence region is the FILL12 sequence region, the FILL14 sequence region, and the FILL17 sequence region. In one embodiment, the filler sequence region is the FILL12 sequence region, the FILL14 sequence region, and the FILL18 sequence region. In one embodiment, the filler sequence region is the FILL12 sequence region, the FILL15 sequence region, and the FILL16 sequence region. In one embodiment, the filler sequence region is the FILL12 sequence region, the FILL15 sequence region, and the FILL17 sequence region. In one embodiment, the filler sequence region is the FILL12 sequence region, the FILL15 sequence region, and the FILL18 sequence region. In one embodiment, the filler sequence region is the FILL12 sequence region, the FILL16 sequence region, and the FILL17 sequence region. In one embodiment, the filler sequence region is the FILL12 sequence region, the FILL16 sequence region, and the FILL18 sequence region. In one embodiment, the filler sequence region is the FILL12 sequence region, the FILL17 sequence region, and the FILL18 sequence region. In one embodiment, the filler sequence region is the FILL13 sequence region, the FILL14 sequence region, and the FILL15 sequence region. In one embodiment, the filler sequence region is the FILL13 sequence region, the FILL14 sequence region, and the FILL16 sequence region. In one embodiment, the filler sequence region is the FILL13 sequence region, the FILL14 sequence region, and the FILL17 sequence region. In one embodiment, the filler sequence region is the FILL13 sequence region, the FILL14 sequence region, and the FILL18 sequence region. In one embodiment, the filler sequence region is the FILL13 sequence region, the FILL15 sequence region, and the FILL16 sequence region. In one embodiment, the filler sequence region is the FILL13 sequence region, the FILL15 sequence region, and the FILL17 sequence region. In one embodiment, the filler sequence region is the FILL13 sequence region, the FILL15 sequence region, and the FILL18 sequence region. In one embodiment, the filler sequence region is the FILL13 sequence region, the FILL16 sequence region, and the FILL17 sequence region. In one embodiment, the filler sequence region is the FILL13 sequence region, the FILL16 sequence region, and the FILL18 sequence region. In one embodiment, the filler sequence region is the FILL13 sequence region, the FILL17 sequence region, and the FILL18 sequence region. In one embodiment, the filler sequence region is the FILL14 sequence region, the FILL15 sequence region, and the FILL16 sequence region. In one embodiment, the filler sequence region is the FILL14 sequence region, the FILL15 sequence region, and the FILL17 sequence region. In one embodiment, the filler sequence region is the FILL14 sequence region, the FILL15 sequence region, and the FILL18 sequence region. In one embodiment, the filler sequence region is the FILL14 sequence region, the FILL16 sequence region, and the FILL17 sequence region. In one embodiment, the filler sequence region is the FILL14 sequence region, the FILL16 sequence region, and the FILL18 sequence region. In one embodiment, the filler sequence region is the FILL14 sequence region, the FILL17 sequence region, and the FILL18 sequence region. In one embodiment, the filler sequence region is the FILL15 sequence region, the FILL16 sequence region, and the FILL17 sequence region. In one embodiment, the filler sequence region is the FILL15 sequence region, the FILL16 sequence region, and the FILL18 sequence region. In one embodiment, the filler sequence region is the FILL15 sequence region, the FILL17 sequence region, and the FILL18 sequence region. In one embodiment, the filler sequence region is the FILL16 sequence region, the FILL17 sequence region, and the FILL18 sequence region.

In one embodiment, the AAV particle viral genome may comprise at least one enhancer sequence region. The enhancer sequence region(s) may, independently, have a length such as, but not limited to, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, and 400 nucleotides. The length of the enhancer region for the viral genome may be 300-310, 300-325, 305-315, 310-320, 315-325, 320-330, 325-335, 325-350, 330-340, 335-345, 340-350, 345-355, 350-360, 350-375, 355-365, 360-370, 365-375, 370-380, 375-385, 375-400, 380-390, 385-395, and 390-400 nucleotides. As a non-limiting example, the viral genome comprises an enhancer region that is about 303 nucleotides in length. As a non-limiting example, the viral genome comprises an enhancer region that is about 382 nucleotides in length.

In one embodiment, the AAV particle viral genome comprises at least one enhancer sequence region. Non-limiting examples of enhancer sequence regions are described in Table 16.

TABLE 16

Enhancer Sequence Regions

| Sequence Region Name | SEQ ID NO |
|---|---|
| Enhancer1 | 1408 |
| Enhancer2 | 1409 |

In one embodiment, the AAV particle viral genome comprises one enhancer sequence region. In one embodiment, the enhancer sequence regions is the Enhancer1 sequence region. In one embodiment, the enhancer sequence regions is the Enhancer2 sequence region.

In one embodiment, the AAV particle viral genome comprises two enhancer sequence regions. In one embodiment, the enhancer sequence regions are the Enhancer1 sequence region and the Enhancer 2 sequence region.

In one embodiment, the AAV particle viral genome may comprise at least one promoter sequence region. The promoter sequence region(s) may, independently, have a length such as, but not limited to, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, and 600 nucleotides. The length of the promoter region for the viral genome may be 4-10, 10-20, 10-50, 20-30, 30-40, 40-50, 50-60, 50-100, 60-70, 70-80, 80-90, 90-100, 100-110, 100-150, 110-120, 120-130, 130-140, 140-150, 150-160, 150-200, 160-170, 170-180, 180-190, 190-200, 200-210, 200-250, 210-220, 220-230, 230-240, 240-250, 250-260, 250-300, 260-270, 270-280, 280-290, 290-300, 300-310, 300-350, 310-320, 320-330, 330-340, 340-350, 350-360, 350-400, 360-370, 370-380, 380-390, 390-400, 400-410, 400-450, 410-420, 420-430, 430-440, 440-450, 450-460, 450-500, 460-470, 470-480, 480-490, 490-500, 500-510, 500-550, 510-520, 520-530, 530-540, 540-550, 550-560, 550-600, 560-570, 570-580, 580-590, and 590-600 nucleotides. As a non-limiting example, the viral genome comprises a promoter region that is about 4 nucleotides in length. As a non-limiting example, the viral genome comprises a promoter region that is about 17 nucleotides in length. As a non-limiting example, the viral genome comprises a promoter region that is about 204 nucleotides in length. As a non-limiting example, the viral genome comprises a promoter region that is about 219 nucleotides in length. As a non-limiting example, the viral genome comprises a promoter region that is about 260 nucleotides in length. As a non-limiting example, the viral genome comprises a promoter region that is about 303 nucleotides in length. As a non-limiting example, the viral genome comprises a promoter region that is about 382 nucleotides in length. As a non-limiting example, the viral genome comprises a promoter region that is about 588 nucleotides in length.

In one embodiment, the AAV particle viral genome comprises at least one promoter sequence region. Non-limiting examples of promoter sequence regions are described in Table 17.

TABLE 17

Promoter Sequence Regions

| Sequence Region Name | SEQ ID NO or Sequence |
|---|---|
| Promoter1 | 1410 |
| Promoter2 | 1411 |
| Promoter3 | GTTG |
| Promoter4 | 1412 |
| Promoter5 | 1413 |
| Promoter6 | 1414 |

In one embodiment, the AAV particle viral genome comprises one promoter sequence region. In one embodiment, the promoter sequence region is Promoter1. In one embodiment, the promoter sequence region is Promoter2. In one embodiment, the promoter sequence region is Promoter3. In one embodiment, the promoter sequence region is Promoter4. In one embodiment, the promoter sequence region is Promoter5. In one embodiment, the promoter sequence region is Promoter6.

In one embodiment, the AAV particle viral genome comprises two promoter sequence regions. In one embodiment, the promoter sequence region is Promoter1 sequence region, and the Promoter2 sequence region. In one embodiment, the promoter sequence region is Promoter1 sequence region, and the Promoter3 sequence region. In one embodiment, the promoter sequence region is Promoter1 sequence region, and the Promoter4 sequence region. In one embodiment, the promoter sequence region is Promoter1 sequence region, and the Promoter5 sequence region. In one embodiment, the promoter sequence region is Promoter1 sequence region, and the Promoter6 sequence region. In one embodiment, the promoter sequence region is Promoter2 sequence region, and the Promoter3 sequence region. In one embodiment, the promoter sequence region is Promoter2 sequence region, and the Promoter4 sequence region. In one embodiment, the promoter sequence region is Promoter2 sequence region, and the Promoter5 sequence region. In one embodiment, the promoter sequence region is Promoter2 sequence region, and the Promoter6 sequence region. In one embodiment, the promoter sequence region is Promoter3 sequence region, and the Promoter4 sequence region. In one embodiment, the promoter sequence region is Promoter3 sequence region, and the Promoter5 sequence region. In one embodiment, the promoter sequence region is Promoter3 sequence region, and the Promoter6 sequence region. In one embodiment, the promoter sequence region is Promoter4 sequence region, and the Promoter5 sequence region. In one embodiment, the promoter sequence region is Promoter4 sequence region, and the Promoter6 sequence region. In one embodiment, the promoter sequence region is Promoter5 sequence region, and the Promoter6 sequence region.

In one embodiment, the AAV particle viral genome may comprise at least one exon sequence region. The exon region(s) may, independently, have a length such as, but not limited to, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41.42, 43, 44, 45, 46, 47, 48, 49, 50, 51, 52, 53.54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, and 150 nucleotides. The length of the exon region for the viral genome may be 2-10, 5-10, 5-15, 10-20, 10-30, 10-40, 15-20, 15-25, 20-30, 20-40, 20-50, 25-30, 25-35, 30-40, 30-50, 30-60, 35-40, 35-45, 40-50, 40-60, 40-70, 45-50, 45-55, 50-60, 50-70, 50-80, 55-60, 55-65, 60-70, 60-80, 60-90, 65-70, 65-75, 70-80, 70-90, 70-100, 75-80, 75-85, 80-90, 80-100, 80-110, 85-90, 85-95, 90-100, 90-110, 90-120, 95-100, 95-105, 100-110, 100-120, 100-130, 105-110, 105-115, 110-120, 110-130, 110-140, 115-120, 115-125, 120-130, 120-140, 120-150, 125-130, 125-135, 130-140, 130-150, 135-140, 135-145, 140-150, and 145-150 nucleotides. As a non-limiting example, the viral genome comprises an exon region that is about 53 nucleotides in length. As a non-limiting example, the viral genome comprises an exon region that is about 134 nucleotides in length.

In one embodiment, the AAV particle viral genome comprises at least one Exon sequence region. Non-limiting examples of Exon sequence regions are described in Table 18.

TABLE 18

Exon Sequence Regions

| Sequence Region Name | SEQ ID NO |
|---|---|
| Exon1 | 1415 |
| Exon2 | 1416 |

In one embodiment, the AAV particle viral genome comprises one Exon sequence region. In one embodiment, the Exon sequence regions is the Exon1 sequence region. In one embodiment, the Exon sequence regions is the Exon2 sequence region.

In one embodiment, the AAV particle viral genome comprises two Exon sequence regions. In one embodiment, the Exon sequence regions are the Exon1 sequence region and the Exon 2 sequence region.

In one embodiment, the AAV particle viral genome may comprise at least one intron sequence region. The intron region(s) may, independently, have a length such as, but not limited to, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, and 350 nucleotides. The length of the intron region for the viral genome may be 25-35, 25-50, 35-45, 45-55, 50-75, 55-65, 65-75, 75-85, 75-100, 85-95, 95-105, 100-125, 105-115, 115-125, 125-135, 125-150, 135-145, 145-155, 150-175, 155-165, 165-175, 175-185, 175-200, 185-195, 195-205, 200-225, 205-215, 215-225, 225-235, 225-250, 235-245, 245-255, 250-275, 255-265, 265-275, 275-285, 275-300, 285-295, 295-305, 300-325, 305-315, 315-325, 325-335, 325-350, and 335-345 nucleotides. As a non-limiting example, the viral genome comprises an intron region that is about 32 nucleotides in length. As a non-limiting example, the viral genome comprises an intron region that is about 172 nucleotides in length. As a non-limiting example, the viral genome comprises an intron region that is about 201 nucleotides in length. As a non-limiting example, the viral genome comprises an intron region that is about 347 nucleotides in length.

In one embodiment, the AAV particle viral genome comprises at least one intron sequence region. Non-limiting examples of intron sequence regions are described in Table 19.

TABLE 19

Intron Sequence Regions

| Sequence Region Name | SEQ ID NO |
|---|---|
| Intron1 | 1417 |
| Intron2 | 1418 |
| Intron3 | 1419 |

In one embodiment, the AAV particle viral genome comprises one intron sequence region. In one embodiment, the intron sequence regions is the Intron sequence region. In one embodiment, the intron sequence regions is the Intron2 sequence region. In one embodiment, the intron sequence regions is the Intron3 sequence region.

In one embodiment, the AAV particle viral genome comprises two intron sequence regions. In one embodiment, the intron sequence regions are the Intron sequence region and the Intron2 sequence region. In one embodiment, the intron sequence regions are the Intron2 sequence region and the Intron3 sequence region. In one embodiment, the intron sequence regions are the Intron1 sequence region and the Intron3 sequence region.

In one embodiment, the AAV particle viral genome comprises three intron sequence regions. In one embodiment, the intron sequence regions are the Intron1 sequence region, the Intron2 sequence region, and the Intron3 sequence region.

In one embodiment, the AAV particle viral genome may comprise at least one polyadenylation signal sequence region. The polyadenylation signal region sequence region(s) may, independently, have a length such as, but not limited to, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415.416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473.474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, and 600 nucleotides. The length of the polyadenylation signal sequence region for the viral genome may be 4-10, 10-20, 10-50, 20-30, 30-40, 40-50, 50-60, 50-100, 60-70, 70-80, 80-90, 90-100, 100-110, 100-150, 110-120, 120-130, 130-140, 140-150, 150-160, 150-200, 160-170, 170-180, 180-190, 190-200, 200-210, 200-250, 210-220, 220-230, 230-240, 240-250, 250-260, 250-300, 260-270, 270-280, 280-290, 290-300, 300-310, 300-350, 310-320, 320-330, 330-340, 340-350, 350-360, 350-400, 360-370, 370-380, 380-390, 390-400, 400-410, 400-450, 410-420, 420-430, 430-440, 440-450, 450-460, 450-500, 460-470, 470-480, 480-490, 490-500, 500-510, 500-550, 510-520, 520-530, 530-540, 540-550, 550-560, 550-600, 560-570, 570-580, 580-590, and 590-600 nucleotides. As a non-limiting example, the viral genome comprises a polyadenylation signal sequence region that is about 127 nucleotides in length. As a non-limiting example, the viral genome comprises a polyadenylation signal sequence region that is about 225 nucleotides in length. As a non-limiting example, the viral genome comprises a polyadenylation signal sequence region that is about 476 nucleotides in length. As a non-limiting example, the viral genome comprises a polyadenylation signal sequence region that is about 477 nucleotides in length.

In one embodiment, the AAV particle viral genome comprises at least one polyadenylation (polyA) signal sequence region. Non-limiting examples of polyA signal sequence regions are described in Table 20.

TABLE 20

PolyA Signal Sequence Regions

| Sequence Region Name | SEQ ID NO |
|---|---|
| PolyA1 | 1420 |
| PolyA2 | 1421 |
| PolyA3 | 1422 |
| PolyA4 | 1423 |

In one embodiment, the AAV particle viral genome comprises one polyA signal sequence region. In one embodiment, the polyA signal sequence regions is the PolyA1 sequence region. In one embodiment, the polyA signal sequence regions is the PolyA2 sequence region. In one embodiment, the polyA signal sequence regions is the PolyA3 sequence region. In one embodiment, the polyA signal sequence regions is the PolyA4 sequence region.

In one embodiment, the AAV particle viral genome comprises more than one polyA signal sequence region.

In one embodiment, the AAV particle viral genome comprises at least one inverted terminal repeat (ITR) sequence region, at least one multiple cloning site (MCS) sequence region, at least one enhancer sequence region, at least one promoter sequence region, at least one exon sequence region, at least one intron sequence region, at least one modulatory polynucleotide region, at least one polyadenylation signal sequence region, and at least one filler sequence region.

In one embodiment, the AAV particle viral genome comprises a 5' inverted terminal repeat (ITR) sequence region and a 3' ITR sequence region, two multiple cloning site (MCS) sequence regions, an enhancer sequence region, a promoter sequence region, an intron sequence region, a modulatory polynucleotide region, a polyadenylation signal sequence region, and a filler sequence region.

In one embodiment, the AAV particle viral genome comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and a filler sequence region. Non-limiting examples of ITR to ITR sequences for use in the AAV particles of the present invention having all of the sequence modules above are described in Table 21. In Table 21, the sequence identifier or sequence of the sequence region (Region SEQ ID NO) and the length of the sequence region (Region length) are described as well as the name and sequence identifier of the ITR to ITR sequence (e.g., VOYHT1 (SEQ ID NO: 1352)).

TABLE 21

Sequence Regions in ITR to ITR Sequences

| Sequence Regions | VOYHT1 (SEQ ID NO: 1352) | | VOYHT2 (SEQ ID NO: 1353) | | VOYHT3 (SEQ ID NO: 1354) | | VOYHT4 (SEQ ID NO: 1355) | |
|---|---|---|---|---|---|---|---|---|
| | Region SEQ ID NO | Region length | Region SEQ ID NO | Region length | Region SEQ ID NO | Region length | Region SEQ ID NO | Region length |
| 5' ITR | 1380 | 141 | 1380 | 141 | 1380 | 141 | 1380 | 141 |
| MCS | 1384 | 10 | 1384 | 10 | 1384 | 10 | 1384 | 10 |
| CMV enhancer | 1408 | 382 | 1408 | 382 | 1408 | 382 | 1408 | 382 |
| CBA Promoter | 1410 | 260 | 1410 | 260 | 1410 | 260 | 1410 | 260 |
| SV40 Intron | 1417 | 172 | 1417 | 172 | 1417 | 172 | 1417 | 172 |
| Modulatory Polynucleotide | 1262 | 163 | 1262 | 163 | 1250 | 158 | 1347 | 163 |
| MCS | TCGAG | 5 | TCGAG | 5 | TCGAG | 5 | TCGAG | 5 |
| Rabbit globin PolyA Signal | 1420 | 127 | 1420 | 127 | 1420 | 127 | 1420 | 127 |
| Filler | 1400 | 714 | 1401 | 3021 | 1400 | 714 | 1400 | 714 |
| 3' ITR | 1382 | 141 | 1382 | 141 | 1382 | 141 | 1382 | 141 |

In one embodiment, the AAV particle viral genome comprises SEQ ID NO: 1352 (VOYHT1) which comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and a filler sequence region.

In one embodiment, the AAV particle viral genome comprises SEQ ID NO: 1353 (VOYHT2) which comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and a filler sequence region.

In one embodiment, the AAV particle viral genome comprises SEQ ID NO: 1354 (VOYHT3) which comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and a filler sequence region.

In one embodiment, the AAV particle viral genome comprises SEQ ID NO: 1355 (VOYHT4) which comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and a filler sequence region.

In one embodiment, the AAV particle viral genome comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and a filler sequence region. Non-limiting examples of ITR to ITR sequences for use in the AAV particles of the present invention having all of the sequence modules above are described in Table 22. In Table 22, the sequence identifier or sequence of the sequence region (Region SEQ ID NO) and the length of the sequence region (Region length) are described as well as the name and sequence identifier of the ITR to ITR sequence (e.g., VOYHT5 (SEQ ID NO: 1356)).

In one embodiment, the AAV particle viral genome comprises SEQ ID NO: 1357 (VOYHT6) which comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and a filler sequence region.

In one embodiment, the AAV particle viral genome comprises SEQ ID NO: 1358 (VOYHT7) which comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and a filler sequence region.

In one embodiment, the AAV particle viral genome comprises SEQ ID NO: 1359 (VOYHT8) which comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and a filler sequence region.

In one embodiment, the AAV particle viral genome comprises a 5' inverted terminal repeat (ITR) sequence region and a 3' ITR sequence region, two multiple cloning site (MCS) sequence regions, an enhancer sequence region, a promoter sequence region, an intron sequence region, a modulatory polynucleotide region, a polyadenylation signal sequence region, and two filler sequence regions.

In one embodiment, the AAV particle viral genome comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and two filler sequence regions. Non-limiting examples of ITR to ITR sequences for use in the AAV particles of the present invention having all of the sequence modules above are described in Table 23. In Table 23, the sequence identifier or sequence of the sequence region (Region SEQ ID NO) and the length of the sequence region (Region length) are described as well as the name and sequence identifier of the ITR to ITR sequence (e.g., VOYHT9 (SEQ ID NO: 1360)).

TABLE 22

Sequence Regions in ITR to ITR Sequences

| Sequence Regions | VOYHT5 (SEQ ID NO: 1356) | | VOYHT6 (SEQ ID NO: 1357) | | VOYHT7 (SEQ ID NO: 1358) | | VOYHT8 (SEQ ID NO: 1359) | |
|---|---|---|---|---|---|---|---|---|
|  | Region SEQ ID NO | Region length | Region SEQ ID NO | Region length | Region SEQ ID NO | Region length | Region SEQ ID NO | Region length |
| 5' ITR | 1380 | 141 | 1380 | 141 | 1380 | 141 | 1380 | 141 |
| MCS | 1384 | 10 | 1384 | 10 | 1384 | 10 | 1384 | 10 |
| Filler | 1390 | 3013 | 1391 | 712 | 1391 | 717 | 1391 | 712 |
| CMV enhancer | 1408 | 382 | 1408 | 382 | 1408 | 382 | 1408 | 382 |
| CBA Promoter | 1410 | 260 | 1410 | 260 | 1410 | 260 | 1410 | 260 |
| SV40 Intron | 1417 | 172 | 1417 | 172 | 1417 | 172 | 1417 | 172 |
| Modulatory Polynucleotide | 1262 | 163 | 1262 | 163 | 1250 | 158 | 1347 | 163 |
| MCS | TCGAG | 5 | TCGAG | 5 | TCGAG | 5 | TCGAG | 5 |
| Rabbit globin PolyA Signal | 1420 | 127 | 1420 | 127 | 1420 | 127 | 1420 | 127 |
| 3' ITR | 1382 | 141 | 1382 | 141 | 1382 | 141 | 1382 | 141 |

TABLE 23

Sequence Regions in ITR to ITR Sequences

| Sequence Regions | VOYHT9 (SEQ ID NO: 1360) | | VOYHT10 (SEQ ID NO: 1361) | | VOYHT11 (SEQ ID NO: 1362) | | VOYHT12 (SEQ ID NO: 1363) | |
|---|---|---|---|---|---|---|---|---|
| | Region SEQ ID NO | Region length | Region SEQ ID NO | Region length | Region SEQ ID NO | Region length | Region SEQ ID NO | Region length |
| 5' ITR | 1380 | 141 | 1380 | 141 | 1380 | 141 | 1380 | 141 |
| MCS | 1384 | 10 | 1384 | 10 | 1384 | 10 | 1384 | 10 |
| Filler | 1396 | 1512 | 1397 | 363 | 1397 | 363 | 1397 | 363 |
| CMV enhancer | 1408 | 382 | 1408 | 382 | 1408 | 382 | 1408 | 382 |
| CBA Promoter | 1410 | 260 | 1410 | 260 | 1410 | 260 | 1410 | 260 |
| SV40 Intron | 1417 | 172 | 1417 | 172 | 1417 | 172 | 1417 | 172 |
| Modulatory Polynucleotide | 1262 | 163 | 1262 | 163 | 1250 | 158 | 1347 | 163 |
| MCS | TCGAG | 5 | TCGAG | 5 | TCGAG | 5 | TCGAG | 5 |
| Rabbit globin PolyA Signal | 1420 | 127 | 1420 | 127 | 1420 | 127 | 1420 | 127 |
| Filler | 1404 | 1519 | 1405 | 357 | 1405 | 357 | 1405 | 357 |
| 3' ITR | 1382 | 141 | 1382 | 141 | 1382 | 141 | 1382 | 141 |

In one embodiment, the AAV particle viral genome comprises SEQ ID NO: 1362 (VOYHT11) which comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and two filler sequence regions.

In one embodiment, the AAV particle viral genome comprises SEQ ID NO: 1363 (VOYHT12) which comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, a rabbit globin polyadenylation signal sequence region, and two filler sequence regions.

In one embodiment, the AAV particle viral genome comprises a 5' inverted terminal repeat (ITR) sequence region and a 3' ITR sequence region, two multiple cloning site (MCS) sequence regions, an enhancer sequence region, a promoter sequence region, an intron sequence region, a modulatory polynucleotide region, and a polyadenylation signal sequence region.

In one embodiment, the AAV particle viral genome comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, and a rabbit globin polyadenylation signal sequence region. Non-limiting examples of ITR to ITR sequences for use in the AAV particles of the present invention having all of the sequence modules above are described in Table 24. In Table 24, the sequence identifier or sequence of the sequence region (Region SEQ ID NO) and the length of the sequence region (Region length) are described as well as the name and sequence identifier of the ITR to ITR sequence (e.g., VOYHT13 (SEQ ID NO: 1364)).

TABLE 24

Sequence Regions in ITR to ITR Sequences

| Sequence Regions | VOYHT13 (SEQ ID NO: 1364) | | VOYHT14 (SEQ ID NO: 1365) | |
|---|---|---|---|---|
| | Region SEQ ID NO | Region length | Region SEQ ID NO | Region length |
| 5' ITR | 1380 | 141 | 1380 | 141 |
| MCS | 1384 | 10 | 1384 | 10 |
| CMV enhancer | 1408 | 382 | 1408 | 382 |
| CBA Promoter | 1410 | 260 | 1410 | 260 |
| SV40 Intron | 1417 | 172 | 1417 | 172 |
| Modulatory Polynucleotide | 1262 | 163 | 1249 | 158 |
| MCS | TCGAG | 5 | TCGAG | 5 |
| Rabbit globin PolyA Signal | 1420 | 127 | 1420 | 127 |
| 3' ITR | 1382 | 141 | 1382 | 141 |

In one embodiment, the AAV particle viral genome comprises SEQ ID NO: 1364 (VOYHT13) which comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1365 (VOYHT14) which comprises a 5' inverted terminal repeat (ITR) sequence region and a 3' ITR sequence region, two multiple cloning site (MCS) sequence regions, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises a 5' inverted terminal repeat (ITR) sequence region and a 3' ITR sequence region, an enhancer sequence region, a promoter sequence region, an intron sequence region, a modulatory polynucleotide region, and a polyadenylation signal sequence region.

In one embodiment, the AAV particle viral genome comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region. Non-limiting examples of ITR to ITR sequences for use in the AAV particles of the present invention having all of the sequence modules above are described in Tables 25-29. In Tables 25-29, the sequence identifier or sequence of the sequence region (Region SEQ ID NO) and the length of the sequence region (Region length) are described as well as the name and sequence identifier of the ITR to ITR sequence (e.g., VOYHT15 (SEQ ID NO: 1366)).

TABLE 25

Sequence Regions in ITR to ITR Sequences

| Sequence Regions | VOYHT15 (SEQ ID NO: 1366) | | VOYHT16 (SEQ ID NO: 1367) | |
|---|---|---|---|---|
| | Region SEQ ID NO | Region length | Region SEQ ID NO | Region length |
| 5' ITR | 1381 | 105 | 1381 | 105 |
| CMV enhancer | 1408 | 382 | 1408 | 382 |
| CBA Promoter | 1410 | 260 | 1410 | 260 |
| SV40 Intron | 1417 | 172 | 1417 | 172 |
| Modulatory Polynucleotide | 1259 | 260 | 1249 | 158 |
| Rabbit globin PolyA Signal | 1420 | 127 | 1420 | 127 |
| 3' ITR | 1383 | 130 | 1383 | 130 |

TABLE 26

Sequence Regions in ITR to ITR Sequences

| Sequence Regions | VOYHT35 (SEQ ID NO: 1388) | | VOYHT36 (SEQ ID NO: 1426) | | VOYHT37 (SEQ ID NO: 1427) | | VOYHT38 (SEQ ID NO: 1428) | |
|---|---|---|---|---|---|---|---|---|
| | Region SEQ ID NO | Region length | Region SEQ ID NO | Region length | Region SEQ ID NO | Region length | Region SEQ ID NO | Region length |
| 5' ITR | 1381 | 105 | 1381 | 105 | 1381 | 105 | 1381 | 105 |
| CMV enhancer | 1408 | 382 | 1408 | 382 | 1408 | 382 | 1408 | 382 |
| CBA Promoter | 1410 | 260 | 1410 | 260 | 1410 | 260 | 1410 | 260 |
| SV40 Intron | 1417 | 172 | 1417 | 172 | 1417 | 172 | 1417 | 172 |
| Modulatory Polynucleotide | 1255 | 158 | 1248 | 158 | 1231 | 158 | 1219 | 158 |
| Rabbit globin PolyA Signal | 1420 | 127 | 1420 | 127 | 1420 | 127 | 1420 | 127 |
| 3' ITR | 1383 | 130 | 1383 | 130 | 1383 | 130 | 1383 | 130 |

TABLE 27

Sequence Regions in ITR to ITR Sequences

| Sequence Regions | VOYHT39 (SEQ ID NO: 1429) | | VOYHT40 (SEQ ID NO: 1430) | | VOYHT41 (SEQ ID NO: 1431) | | VOYHT42 (SEQ ID NO: 1432) | |
|---|---|---|---|---|---|---|---|---|
| | Region SEQ ID NO | Region length | Region SEQ ID NO | Region length | Region SEQ ID NO | Region length | Region SEQ ID NO | Region length |
| 5' ITR | 1381 | 105 | 1381 | 105 | 1381 | 105 | 1381 | 105 |
| CMV enhancer | 1408 | 382 | 1408 | 382 | 1408 | 387 | 1408 | 382 |
| CBA Promoter | 1410 | 260 | 1410 | 260 | 1410 | 260 | 1410 | 260 |
| SV40 Intron | 1417 | 172 | 1417 | 172 | 1417 | 172 | 1417 | 172 |
| Modulatory Polynucleotide | 1207 | 158 | 1250 | 158 | 1251 | 158 | 1252 | 158 |
| Rabbit globin PolyA Signal | 1420 | 127 | 1420 | 127 | 1420 | 127 | 1420 | 127 |
| 3' ITR | 1383 | 130 | 1383 | 130 | 1383 | 130 | 1383 | 130 |

TABLE 28

Sequence Regions in ITR to ITR Sequences

| Sequence Regions | VOYHT43 (SEQ ID NO: 1433) | | VOYHT44 (SEQ ID NO: 1434) | | VOYHT45 (SEQ ID NO: 1435) | | VOYHT46 (SEQ ID NO: 1436) | |
|---|---|---|---|---|---|---|---|---|
| | Region SEQ ID NO | Region length | Region SEQ ID NO | Region length | Region SEQ ID NO | Region length | Region SEQ ID NO | Region length |
| 5' ITR | 1381 | 105 | 1381 | 105 | 1381 | 105 | 1381 | 105 |
| CMV enhancer | 1408 | 382 | 1408 | 382 | 1408 | 387 | 1408 | 382 |
| CBA Promoter | 1410 | 260 | 1410 | 260 | 1410 | 260 | 1410 | 260 |
| SV40 Intron | 1417 | 172 | 1417 | 172 | 1417 | 172 | 1417 | 172 |
| Modulatory Polynucleotide | 1253 | 260 | 1194 | 260 | 1223 | 260 | 1211 | 260 |
| Rabbit globin PolyA Signal | 1420 | 127 | 1420 | 127 | 1420 | 127 | 1420 | 127 |
| 3' ITR | 1383 | 130 | 1383 | 130 | 1383 | 130 | 1383 | 130 |

TABLE 29

Sequence Regions in ITR to ITR Sequences

| Sequence Regions | VOYHT47 (SEQ ID NO: 1437) | | VOYHT48 (SEQ ID NO: 1438) | |
|---|---|---|---|---|
| | Region SEQ ID NO | Region length | Region SEQ ID NO | Region length |
| 5' ITR | 1381 | 105 | 1381 | 105 |
| CMV enhancer | 1408 | 382 | 1408 | 382 |
| CBA Promoter | 1410 | 260 | 1410 | 260 |
| SV40 Intron | 1417 | 172 | 1417 | 172 |
| Modulatory Polynucleotide | 1262 | 163 | 1347 | 163 |
| Rabbit globin PolyA Signal | 1420 | 127 | 1420 | 127 |
| 3' ITR | 1383 | 130 | 1383 | 130 |

In one embodiment, the AAV particle viral genome comprises SEQ ID NO: 1366 (VOYHT15) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1367 (VOYHT16) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1388 (VOYHT35) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1426 (VOYHT36) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1427 (VOYHT37) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1428 (VOYHT38) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1429 (VOYHT39) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1430 (VOYHT40) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1431 (VOYHT41) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1432 (VOYHT42) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1433 (VOYHT43) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1434 (VOYHT44) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1435 (VOYHT45) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1436 (VOYHT46) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises SEQ ID NO: 1437 (VOYHT47) which comprises a 5' inverted terminal repeat (ITR) sequence region and a 3' ITR sequence region, a CMV enhancer sequence region, a CBA promoter sequence region, an SV40 intron sequence region, a modulatory) polynucleotide region, and a rabbit globin polyadenylation signal sequence region.

In one embodiment, the AAV particle viral genome comprises SEQ ID NO: 1438 (VOYHT48) which comprises a 5' inverted terminal repeat (ITR) sequence region and a 3' ITR sequence region, a CMV enhancer sequence region, a CBA promoter sequence region, an SV40 intron sequence region, a modulatory polynucleotide region, and a rabbit globin polyadenylation signal sequence region.

In one embodiment, the AAV particle viral genome comprises a 5' inverted terminal repeat (ITR) sequence region and a 3' ITR sequence region, a MCS sequence region, an enhancer sequence region, a promoter sequence region, two exon sequence regions, two intron sequence regions, a modulatory polynucleotide region, a polyadenylation signal sequence region, and a filler sequence region.

In one embodiment, the AAV particle viral genome comprises a 5' inverted terminal repeat (ITR) sequence region and a 3' ITR sequence region, a MCS sequence region, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin intron 2 or fragments thereof), a modulatory polynucleotide region, a human growth hormone (hGH) polyadenylation signal sequence region, and a filler sequence region. A non-limiting example of an ITR to ITR sequence for use in the AAV particles of the present invention having all of the sequence modules above are described in Table 30. In Table 30, the sequence identifier or sequence of the sequence region (Region SEQ ID NO) and the length of the sequence region (Region length) are described as well as the name and sequence identifier of the ITR to ITR sequence (e.g., VOYHT17 (SEQ ID NO: 1368)).

TABLE 30

Sequence Regions in ITR to ITR Sequences

VOYHT17 (SEQ ID NO: 1368)

| Sequence Regions | Region SEQ ID NO | Region length |
|---|---|---|
| 5' ITR | 1380 | 141 |
| MCS | 1387 | 18 |
| CMV enhancer | 1409 | 303 |
| CMV Promoter | 1412 | 204 |

TABLE 30-continued

Sequence Regions in ITR to ITR Sequences

VOYHT17 (SEQ ID NO: 1368)

| Sequence Regions | Region SEQ ID NO | Region length |
|---|---|---|
| Ie1 exon1 | 1415 | 134 |
| Ie1 intron1 | 1418 | 32 |
| hbglobin intron2 | 1419 | 347 |
| hbglobin exon3 | 1416 | 53 |
| Modulatory Polynucleotide | 1262 | 163 |
| hGH PolyA Signal | 1422 | 477 |
| Filler | 1406 | 2403 |
| 3' ITR | 1382 | 141 |

In one embodiment, the AAV particle viral genome comprises SEQ ID NO: 1368 (VOYHT17) which comprises a 5' inverted terminal repeat (ITR) sequence region and a 3' ITR sequence region, a MCS sequence region, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin intron 2 or fragments thereof), a modulatory polynucleotide region, a human growth hormone (hGH) polyadenylation signal sequence region, and a filler sequence region.

In one embodiment, the AAV particle viral genome comprises a 5' inverted terminal repeat (ITR) sequence region and a 3' ITR sequence region, a MCS sequence region, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin intron 2 or fragments thereof), a modulatory polynucleotide region, a human growth hormone (hGH) polyadenylation signal sequence region, and a filler sequence region. A non-limiting example of an ITR to ITR sequence for use in the AAV particles of the present invention having all of the sequence modules above are described in Table 31. In Table 31, the sequence identifier or sequence of the sequence region (Region SEQ ID NO) and the length of the sequence region (Region length) are described as well as the name and sequence identifier of the ITR to ITR sequence (e.g., VOYHT19 (SEQ ID NO: 1370)).

TABLE 31

Sequence Regions in ITR to ITR Sequences

VOYHT19 (SEQ ID NO: 1370)

| Sequence Regions | Region SEQ ID NO | Region length |
|---|---|---|
| 5' ITR | 1380 | 141 |
| Filler | 1392 | 2405 |
| CMV enhancer | 1409 | 303 |
| CMV Promoter | 1412 | 204 |
| Ie1 exon1 | 1415 | 134 |
| Ie1 intron1 | 1418 | 32 |
| hbglobin intron2 | 1419 | 347 |
| hbglobin exon3 | 1416 | 53 |
| Modulatory Polynucleotide | 1262 | 163 |
| hGH PolyA Signal | 1389 | 14 |
| MCS | 1422 | 477 |
| 3' ITR | 1382 | 141 |

In one embodiment, the AAV particle viral genome comprises SEQ ID NO: 1370 (VOYHT19) which comprises a 5' inverted terminal repeat (ITR) sequence region and a 3' ITR sequence region, a MCS sequence region, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and a filler sequence region.

In one embodiment, the AAV particle viral genome comprises a 5' inverted terminal repeat (ITR) sequence region and a 3' ITR sequence region, two MCS sequence regions, an enhancer sequence region, a promoter sequence region, two exon sequence regions, two intron sequence regions, a modulatory polynucleotide region, a polyadenylation signal sequence region, and a filler sequence region.

In one embodiment, the AAV particle viral genome comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and a filler sequence region. A non-limiting example of an ITR to ITR sequence for use in the AAV particles of the present invention having all of the sequence modules above are described in Table 32. In Table 32, the sequence identifier or sequence of the sequence region (Region SEQ ID NO) and the length of the sequence region (Region length) are described as well as the name and sequence identifier of the ITR to ITR sequence (e.g., VOYHT18 (SEQ ID NO: 1369)).

TABLE 32

Sequence Regions in ITR to ITR Sequences

VOYHT18 (SEQ ID NO: 1369)

| Sequence Regions | Region SEQ ID NO | Region length |
|---|---|---|
| 5' ITR | 1380 | 141 |
| MCS | 1387 | 18 |
| CMV enhancer | 1409 | 303 |
| CMV Promoter | 1412 | 204 |
| Ie1 exon1 | 1415 | 134 |
| Ie1 intron1 | 1418 | 32 |
| hbglobin intron2 | 1419 | 347 |
| hbglobin exon3 | 1416 | 53 |
| Modulatory Polynucleotide | 1262 | 163 |
| MCS | 1389 | 14 |
| hGH PolyA Signal | 1422 | 477 |
| Filler | 1407 | 105 |
| 3' ITR | 1382 | 141 |

In one embodiment, the AAV particle viral genome comprises SEQ ID NO: 1369 (VOYHT18) which comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and a filler sequence region.

In one embodiment, the AAV particle viral genome comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and a filler sequence region. A non-limiting example of an ITR to ITR sequence for use in the AAV particles of the present invention having all of the sequence modules above are described in Table 33. In Table 33, the sequence identifier or sequence of the sequence region (Region SEQ ID NO) and the length of the sequence region (Region length) are described as well as the name and sequence identifier of the ITR to ITR sequence (e.g., VOYHT20 (SEQ ID NO: 1371)).

TABLE 33

Sequence Regions in ITR to ITR Sequences

VOYHT20 (SEQ ID NO: 1371)

| Sequence Regions | Region SEQ ID NO | Region length |
|---|---|---|
| 5' ITR | 1380 | 141 |
| MCS | 1385 | 121 |
| Filler | 1394 | 103 |
| CMV enhancer | 1409 | 303 |
| CMV Promoter | 1412 | 204 |
| Ie1 exon1 | 1415 | 134 |
| Ie1 intron1 | 1418 | 32 |
| hbglobin intron2 | 1419 | 347 |
| hbglobin exon3 | 1416 | 53 |
| Modulatory Polynucleotide | 1262 | 163 |
| MCS | 1389 | 14 |
| hGH PolyA Signal | 1422 | 477 |
| 3' ITR | 1382 | 141 |

In one embodiment, the AAV particle viral genome comprises SEQ ID NO: 1371 (VOYHT20) which comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and a filler sequence region.

In one embodiment, the AAV particle viral genome comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and a filler sequence region. Non-limiting examples of ITR to ITR sequences for use in the AAV particles of the present invention having all of the sequence modules above are described in Table 34. In Table 34, the sequence identifier or sequence of the sequence region (Region SEQ ID NO) and the length of the sequence region (Region length) are described as well as the name and sequence identifier of the ITR to ITR sequence (e.g., VOYHT21 (SEQ ID NO: 1372)).

TABLE 34

Sequence Regions in ITR to ITR Sequences

| Sequence Regions | VOYHT21 (SEQ ID NO: 1372) | | VOYHT22 (SEQ ID NO: 1373) | |
|---|---|---|---|---|
| | Region SEQ ID NO | Region length | Region SEQ ID NO | Region length |
| 5' ITR | 1380 | 141 | 1380 | 141 |
| MCS | 1387 | 18 | 1387 | 18 |
| CMV enhancer | 1409 | 303 | 1409 | 303 |
| CMV Promoter | 1412 | 204 | 1412 | 204 |
| Ie1 exon1 | 1415 | 134 | 1415 | 134 |
| Ie1 intron1 | 1418 | 32 | 1418 | 32 |
| Filler | 1398 | 2395 | 1399 | 97 |
| hbglobin intron2 | 1419 | 347 | 1419 | 347 |
| hbglobin exon3 | 1416 | 53 | 1416 | 53 |
| Modulatory Polynucleotide | 1262 | 163 | 1262 | 163 |
| MCS | 1389 | 14 | 1389 | 14 |
| hGH PolyA Signal | 1422 | 477 | 1422 | 477 |
| 3' ITR | 1382 | 141 | 1382 | 141 |

In one embodiment, the AAV particle viral genome comprises SEQ ID NO 1372 (VOYHT21) which comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and a filler sequence region.

In one embodiment, the AAV particle viral genome comprises SEQ ID NO: 1373 (VOYHT22) which comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and a filler sequence region.

In one embodiment, the AAV particle viral genome comprises a 5' inverted terminal repeat (ITR) sequence region and a 3' ITR sequence region, a MCS sequence region, an enhancer sequence region, a promoter sequence region, two exon sequence regions, two intron sequence regions, a modulatory polynucleotide region, a polyadenylation signal sequence region, and two filler sequence regions.

In one embodiment, the AAV particle viral genome comprises a 5' inverted terminal repeat (ITR) sequence region and a 3' ITR sequence region, a MCS sequence region, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and two filler sequence regions. A non-limiting example of an ITR to ITR sequence for use in the AAV particles of the present invention having all of the sequence modules above are described in Table 35. In Table 35, the sequence identifier or sequence of the sequence region (Region SEQ ID NO) and the length of the sequence region (Region length) are described as well as the name and sequence identifier of the ITR to ITR sequence (e.g., VOYHT23 (SEQ ID NO: 1374)).

TABLE 35

Sequence Regions in ITR to ITR Sequences

| | VOYHT23 (SEQ ID NO: 1374) | |
|---|---|---|
| Sequence Regions | Region SEQ ID NO | Region length |
| 5' ITR | 1380 | 141 |
| Filler | 1393 | 1203 |
| CMV enhancer | 1409 | 303 |
| CMV Promoter | 1412 | 204 |
| Ie1 exon1 | 1415 | 134 |
| Ie1 intron1 | 1418 | 32 |
| hbglobin intron2 | 1419 | 347 |
| hbglobin exon3 | 1416 | 53 |
| Modulatory Polynucleotide | 1262 | 163 |
| MCS | 1389 | 14 |
| hGH PolyA Signal | 1422 | 477 |
| Filler | 1402 | 1209 |
| 3' ITR | 1382 | 141 |

In one embodiment, the AAV particle viral genome comprises SEQ ID NO: 1374 (VOYHT23) which comprises a 5' inverted terminal repeat (ITR) sequence region and a 3' ITR sequence region, a MCS sequence region, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and two filler sequence regions.

In one embodiment, the AAV particle viral genome comprises a 5' inverted terminal repeat (ITR) sequence region and a 3' ITR sequence region, two MCS sequence regions, an enhancer sequence region, a promoter sequence region, two exon sequence regions, two intron sequence regions, a modulatory polynucleotide region, a polyadenylation signal sequence region, and two filler sequence regions.

In one embodiment, the AAV particle viral genome comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and two filler sequence regions. A non-limiting example of an ITR to ITR sequence for use in the AAV particles of the present invention having all of the sequence modules above are described in Table 36. In Table 36, the sequence identifier or sequence of the sequence region (Region SEQ ID NO) and the length of the sequence region (Region length) are described as well as the name and sequence identifier of the ITR to ITR sequence (e.g., VOYHT24 (SEQ ID NO: 1375)).

TABLE 36

Sequence Regions in ITR to ITR Sequences

| | VOYHT24 (SEQ ID NO: 1375) | |
|---|---|---|
| Sequence Regions | Region SEQ ID NO | Region length |
| 5' ITR | 1380 | 141 |
| MCS | 1386 | 73 |

TABLE 36-continued

Sequence Regions in ITR to ITR Sequences

| Sequence Regions | VOYHT24 (SEQ ID NO: 1375) | |
|---|---|---|
| | Region SEQ ID NO | Region length |
| Filler | 1395 | 55 |
| CMV enhancer | 1409 | 303 |
| CMV Promoter | 1412 | 204 |
| Ie1 exon1 | 1415 | 134 |
| Ie1 intron1 | 1418 | 32 |
| hbglobin intron2 | 1419 | 347 |
| hbglobin exon3 | 1416 | 53 |
| Modulatory Polynucleotide | 1262 | 163 |
| MCS | 1389 | 14 |
| hGH PolyA Signal | 1423 | 476 |
| Filler | 1403 | 56 |
| 3' ITR | 1382 | 141 |

In one embodiment, the AAV particle viral genome comprises SEQ ID NO: 1375 (VOYHT24) which comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, a human growth hormone (hGH) polyadenylation signal sequence region, and two filler sequence regions.

In one embodiment, the AAV particle viral genome comprises a 5' inverted terminal repeat (ITR) sequence region and a 3' ITR sequence region, two MCS sequence regions, an enhancer sequence region, a promoter sequence region, two exon sequence regions, two intron sequence regions, a modulatory polynucleotide region, and a polyadenylation signal sequence region.

In one embodiment, the AAV particle viral genome comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, and a human growth hormone (hGH) polyadenylation signal sequence region. Non-limiting examples of an ITR to ITR sequences for use in the AAV particles of the present invention having all of the sequence modules above are described in Table 37. In Table 37, the sequence identifier or sequence of the sequence region (Region SEQ ID NO) and the length of the sequence region (Region length) are described as well as the name and sequence identifier of the ITR to ITR sequence (e.g., VOYHT25 (SEQ ID NO: 1376)).

TABLE 37

Sequence Regions in ITR to ITR Sequences

| Sequence Regions | VOYHT25 (SEQ ID NO: 1376) | | VOYHT26 (SEQ ID NO: 1377) | |
|---|---|---|---|---|
| | Region SEQ ID NO | Region length | Region SEQ ID NO | Region length |
| 5' ITR | 1380 | 141 | 1380 | 141 |
| MCS | 1387 | 18 | 1387 | 18 |
| CMV enhancer | 1409 | 303 | 1409 | 303 |
| CMV Promoter | 1412 | 204 | 1412 | 204 |
| Ie1 exon1 | 1415 | 134 | 1415 | 134 |
| Ie1 intron1 | 1418 | 32 | 1418 | 32 |
| hbglobin intron2 | 1419 | 347 | 1419 | 347 |
| hbglobin exon3 | 1416 | 53 | 1416 | 53 |
| Modulatory Polynucleotide | 1249 | 158 | 1262 | 163 |
| MCS | 1389 | 14 | 1389 | 14 |
| hGH PolyA Signal | 1422 | 477 | 1422 | 477 |
| 3' ITR | 1382 | 141 | 1382 | 141 |

In one embodiment, the AAV particle viral genome comprises SEQ ID NO: 1376 (VOYHT25) which comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, and a human growth hormone (hGH) polyadenylation signal sequence region.

In one embodiment, the AAV particle viral genome comprises SEQ ID NO: 1377 (VOYHT26) which comprises a 5' inverted terminal repeat (ITR) sequence region and a 3' ITR sequence region, two MCS sequence regions, a CMV enhancer sequence region, a CMV promoter sequence region, two exon sequence regions (ie1 exon 1 and human beta globin (hbglobin) exon 3 or fragments thereof), two intron sequence regions (ie1 intron 1 and hbglobin exon 3 or fragments thereof), a modulatory polynucleotide region, and a human growth hormone (hGH) polyadenylation signal sequence region.

In one embodiment, the AAV particle viral genome comprises a 5' inverted terminal repeat (ITR) sequence region and a 3' ITR sequence region, a promoter sequence region, and a modulatory polynucleotide region.

In one embodiment, the AAV particle viral genome comprises a 5' inverted terminal repeat (ITR) sequence region and a 3' ITR sequence region, an H1 promoter sequence region, and a modulatory polynucleotide region. Non-limiting examples of an ITR to ITR sequences for use in the AAV particles of the present invention having all of the sequence modules above are described in Table 38. In Table 38, the sequence identifier or sequence of the sequence region (Region SEQ ID NO) and the length of the sequence region (Region length) are described as well as the name and sequence identifier of the ITR to ITR sequence (e.g., VOYHT27 (SEQ ID NO: 1378)).

TABLE 38

Sequence Regions in ITR to ITR Sequences

| Sequence Regions | VOYHT27 (SEQ ID NO: 1378) | | VOYHT28 (SEQ ID NO: 1379) | |
|---|---|---|---|---|
| | Region SEQ ID NO | Region length | Region SEQ ID NO | Region length |
| 5' ITR | 1381 | 105 | 1381 | 105 |
| H1 Promoter | 1413 | 219 | 1413 | 219 |

TABLE 38-continued

Sequence Regions in ITR to ITR Sequences

| Sequence Regions | VOYHT27 (SEQ ID NO: 1378) | | VOYHT28 (SEQ ID NO: 1379) | |
|---|---|---|---|---|
| | Region SEQ ID NO | Region length | Region SEQ ID NO | Region length |
| Modulatory Polynucleotide | 1259 | 260 | 1249 | 158 |
| 3' ITR | 1383 | 130 | 1383 | 130 |

In one embodiment, the AAV particle viral genome comprises SEQ ID NO: 1378 (VOYHT27) which comprises a 5' inverted terminal repeat (ITR) sequence region and a 3' ITR sequence region, an H1 promoter sequence region, and a modulatory polynucleotide region.

In one embodiment, the AAV particle viral genome comprises SEQ ID NO: 1379 (VOYHT28) which comprises a 5' inverted terminal repeat (ITR) sequence region and a 3' ITR sequence region, an H1 promoter sequence region, and a modulatory polynucleotide region.

In one embodiment, the AAV particle viral genome comprises one or two promoter sequence regions, a modulatory polynucleotide sequence region, and a bovine growth hormone (bGH) polyadenylation signal sequence region.

In one embodiment, the AAV particle viral genome comprises a two promoter sequence regions, a modulatory polynucleotide region, and a polyadenylation signal sequence region.

In one embodiment, the AAV particle viral genome comprises a CMV and T7 promoter sequence region, a modulatory polynucleotide region, and a bGH polyadenylation signal sequence region. Non-limiting examples of sequences for use in the AAV particles of the present invention having all of the sequence modules above are described in Table 39. In Table 39, the sequence identifier or sequence of the sequence region (Region SEQ ID NO) and the length of the sequence region (Region length) are described as well as the name of the sequence (e.g., VOYHT29).

In one embodiment, the AAV particle viral genome comprises a CMV promoter sequence region (SEQ ID NO: 1411), a T7 promoter sequence region (SEQ ID NO: 1414), a modulatory polynucleotide sequence region (SEQ ID NO: 1249), and a bGH polyadenylation signal sequence region (SEQ ID NO: 1421).

In one embodiment, the AAV particle viral genome comprises a CMV promoter sequence region (SEQ ID NO: 1411), a T7 promoter sequence region (SEQ ID NO: 1414), a modulatory polynucleotide sequence region (SEQ ID NO: 1259), and a bGH polyadenylation signal sequence region (SEQ ID NO: 1421).

In one embodiment, the AAV particle viral genome comprises a CMV promoter sequence region (SEQ ID NO: 1411), a T7 promoter sequence region (SEQ ID NO: 1414), a modulatory polynucleotide sequence region (SEQ ID NO: 1255), and a bGH polyadenylation signal sequence region (SEQ ID NO: 1421).

In one embodiment, the AAV particle viral genome comprises a CMV promoter sequence region (SEQ ID NO: 1411), a T7 promoter sequence region (SEQ ID NO: 1414), a modulatory polynucleotide sequence region (SEQ ID NO: 1253), and a bGH polyadenylation signal sequence region (SEQ ID NO: 1421).

In one embodiment, the AAV particle viral genome comprises one or two promoter sequence regions, and a modulatory polynucleotide sequence region.

In one embodiment, the AAV particle viral genome comprises a CMV and T7 promoter sequence region, and a modulatory polynucleotide region. Non-limiting examples of sequences for use in the AAV particles of the present invention having all of the sequence modules above are described in Table 40. In Table 40, the sequence identifier or sequence of the sequence region (Region SEQ ID NO) and the length of the sequence region (Region length) are described as well as the name of the sequence (e.g., VOYHT33).

TABLE 40

Sequence Regions

| Sequence Regions | VOYHT33 | | VOYHT34 | |
|---|---|---|---|---|
| | Region SEQ ID NO | Region length | Region SEQ ID NO | Region length |
| CMV Promoter | GTTG | 4 | — | — |
| H1 Promoter | 1413 | 219 | 1413 | 219 |
| Modulatory Polynucleotide | 1249 | 158 | 1259 | 260 |

TABLE 39

Sequence Regions

| Sequence Regions | VOYHT29 | | VOYHT30 | | VOYHT31 | | VOYHT32 | |
|---|---|---|---|---|---|---|---|---|
| | Region SEQ ID NO | Region length | Region SEQ ID NO | Region length | Region SEQ ID NO | Region length | Region SEQ ID NO | Region length |
| CMV Promoter | 1411 | 588 | 1411 | 588 | 1411 | 588 | 1411 | 588 |
| T7 promoter | 1414 | 17 | 1414 | 17 | 1414 | 17 | 1414 | 17 |
| Modulatory Poly nucleotide | 1249 | 158 | 1259 | 260 | 1255 | 158 | 1253 | 260 |
| bGH PolyA Signal | 1421 | 225 | 1421 | 225 | 1421 | 225 | 1421 | 225 |

In one embodiment, the AAV particle viral genome comprises a CMV promoter sequence region (Sequence: GTTG), a H1 promoter sequence region (SEQ ID NO: 1413), and a modulatory polynucleotide sequence region (SEQ ID NO: 1249).

In one embodiment, the AAV particle viral genome comprises a H1 promoter sequence region (SEQ ID NO: 1413), and a modulatory polynucleotide sequence region (SEQ ID NO: 1259).

AAV particles may be modified to enhance the efficiency of delivery. Such modified AAV particles comprising the nucleic acid sequence encoding the siRNA molecules of the present invention can be packaged efficiently and can be used to successfully infect the target cells at high frequency and with minimal toxicity.

In some embodiments, the AAV particle comprising a nucleic acid sequence encoding the siRNA molecules of the present invention may be a human serotype AAV particle. Such human AAV particle may be derived from any known serotype, e.g., from any one of serotypes AAV1-AAV11. As non-limiting examples, AAV particles may be vectors comprising an AAV1-derived genome in an AAV1-derived capsid; vectors comprising an AAV2-derived genome in an AAV2-derived capsid; vectors comprising an AAV4-derived genome in an AAV4 derived capsid; vectors comprising an AAV6-derived genome in an AAV6 derived capsid or vectors comprising an AAV9-derived genome in an AAV9 derived capsid.

In other embodiments, the AAV particle comprising a nucleic acid sequence for encoding siRNA molecules of the present invention may be a pseudotyped hybrid or chimeric AAV particle which contains sequences and/or components originating from at least two different AAV serotypes. Pseudotyped AAV particles may be vectors comprising an AAV genome derived from one AAV serotype and a capsid protein derived at least in part from a different AAV serotype. As non-limiting examples, such pseudotyped AAV particles may be vectors comprising an AAV2-derived genome in an AAV1-derived capsid; or vectors comprising an AAV2-derived genome in an AAV6-derived capsid; or vectors comprising an AAV2-derived genome in an AAV4-derived capsid; or an AAV2-derived genome in an AAV9-derived capsid. In like fashion, the present invention contemplates any hybrid or chimeric AAV particle.

In other embodiments, AAV particles comprising a nucleic acid sequence encoding the siRNA molecules of the present invention may be used to deliver siRNA molecules to the central nervous system (e.g., U.S. Pat. No. 6,180,613; the contents of which is herein incorporated by reference in its entirety).

In some aspects, the AAV particles comprising a nucleic acid sequence encoding the siRNA molecules of the present invention may further comprise a modified capsid including peptides from non-viral origin. In other aspects, the AAV particle may contain a CNS specific chimeric capsid to facilitate the delivery of encoded siRNA duplexes into the brain and the spinal cord. For example, an alignment of cap nucleotide sequences from AAV variants exhibiting CNS tropism may be constructed to identify variable region (VR) sequence and structure.

Viral Production

The present disclosure provides a method for the generation of parvoviral particles, e.g. AAV particles, by viral genome replication in a viral replication cell comprising contacting the viral replication cell with an AAV polynucleotide or AAV genome.

The present disclosure provides a method for producing an AAV particle having enhanced (increased, improved) transduction efficiency comprising the steps of: 1) co-transfecting competent bacterial cells with a bacmid vector and either a viral construct vector and/or AAV payload construct vector, 2) isolating the resultant viral construct expression vector and AAV payload construct expression vector and separately transfecting viral replication cells, 3) isolating and purifying resultant payload and viral construct particles comprising viral construct expression vector or AAV payload construct expression vector, 4) co-infecting a viral replication cell with both the AAV payload and viral construct particles comprising viral construct expression vector or AAV payload construct expression vector, 5) harvesting and purifying the viral particle comprising a parvoviral genome.

In one embodiment, the present invention provides a method for producing an AAV particle comprising the steps of 1) simultaneously co-transfecting mammalian cells, such as, but not limited to HEK293 cells, with a payload region, a construct expressing rep and cap genes and a helper construct, 2) harvesting and purifying the AAV particle comprising a viral genome.

Cells

The present disclosure provides a cell comprising an AAV polynucleotide and/or AAV genome.

Viral production disclosed herein describes processes and methods for producing AAV particles that contact a target cell to deliver a payload construct, e.g. a recombinant viral construct, which comprises a polynucleotide sequence encoding a payload molecule.

In one embodiment, the AAV particles may be produced in a viral replication cell that comprises an insect cell.

Growing conditions for insect cells in culture, and production of heterologous products in insect cells in culture are well-known in the art, see U.S. Pat. No. 6,204,059, the contents of which are herein incorporated by reference in their entirety.

Any insect cell which allows for replication of parvovirus and which can be maintained in culture can be used in accordance with the present invention. Cell lines may be used from *Spodoptera frugiperda*, including, but not limited to the Sf9 or Sf21 cell lines, *Drosophila* cell lines, or mosquito cell lines, such as *Aedes albopictus* derived cell lines. Use of insect cells for expression of heterologous proteins is well documented, as are methods of introducing nucleic acids, such as vectors, e.g., insect-cell compatible vectors, into such cells and methods of maintaining such cells in culture. See, for example, Methods in Molecular Biology, ed. Richard, Humana Press, NJ (1995); O'Reilly et al., Baculovirus Expression Vectors, A Laboratory Manual, Oxford Univ. Press (1994); Samulski et al., *J. Vir.* 63:3822-8 (1989); Kajigaya et al., *Proc. Nat'l. Acad. Sci. USA* 88: 4646-50 (1991); Ruffing et al., *J. Vir.* 66:6922-30 (1992); Kimbauer et al., *Vir.* 219:37-44 (1996); Zhao et al., Vir. 272:382-93 (2000); and Samulski et al., U.S. Pat. No. 6,204,059, the contents of each of which is herein incorporated by reference in its entirety.

The viral replication cell may be selected from any biological organism, including prokaryotic (e.g., bacterial) cells, and eukaryotic cells, including, insect cells, yeast cells and mammalian cells. Viral replication cells may comprise mammalian cells such as A549, WEH1, 3T3, 10T1/2, BHK, MDCK, COS 1, COS 7, BSC 1, BSC 40, BMT 10, VERO, W138, HeLa, HEK293, Saos, C2C12, L cells, HT1080, HepG2 and primary fibroblast, hepatocyte and myoblast cells derived from mammals. Viral replication cells comprise cells derived from mammalian species including, but not limited to, human, monkey, mouse, rat, rabbit, and hamster or cell type, including but not limited to fibroblast, hepatocyte, tumor cell, cell line transformed cell, etc.

Small Scale Production of AAV Particles

Viral production disclosed herein describes processes and methods for producing AAV particles that contact a target cell to deliver a payload, e.g. a recombinant viral construct, which comprises a polynucleotide sequence encoding a payload.

In one embodiment, the AAV particles may be produced in a viral replication cell that comprises a mammalian cell.

Viral replication cells commonly used for production of recombinant AAV particles include, but are not limited to 293 cells, COS cells, HeLa cells, KB cells, and other mammalian cell lines as described in U.S. Pat. Nos. 6,156,303, 5,387,484, 5,741,683, 5,691,176, and 5,688,676; U.S. patent application 2002/0081721, and International Patent Applications WO 00/47757, WO 00/24916, and WO 96/17947, the contents of each of which are herein incorporated by reference in their entireties.

In one embodiment, AAV particles are produced in mammalian-cells wherein all three VP proteins are expressed at a stoichiometry approaching 1:1:10 (VP1:VP2:VP3). The regulatory mechanisms that allow this controlled level of expression include the production of two mRNAs, one for VP1, and the other for VP2 and VP3, produced by differential splicing.

In another embodiment, AAV particles are produced in mammalian cells using a triple transfection method wherein a payload construct, parvoviral Rep and parvoviral Cap and a helper construct are comprised within three different constructs. The triple transfection method of the three components of AAV particle production may be utilized to produce small lots of virus for assays including transduction efficiency, target tissue (tropism) evaluation, and stability.

Baculovirus

Particle production disclosed herein describes processes and methods for producing AAV particles that contact a target cell to deliver a payload construct which comprises a polynucleotide sequence encoding a payload.

Briefly, the viral construct vector and the AAV payload construct vector are each incorporated by a transposon donor/acceptor system into a bacmid, also known as a baculovirus plasmid, by standard molecular biology techniques known and performed by a person skilled in the art. Transfection of separate viral replication cell populations produces two baculoviruses, one that comprises the viral construct expression vector, and another that comprises the AAV payload construct expression vector. The two baculoviruses may be used to infect a single viral replication cell population for production of AAV particles.

Baculovirus expression vectors for producing viral particles in insect cells, including but not limited to *Spodoptera frugiperda* (Sf9) cells, provide high titers of viral particle product. Recombinant baculovirus encoding the viral construct expression vector and AAV payload construct expression vector initiates a productive infection of viral replicating cells. Infectious baculovirus particles released from the primary infection secondarily infect additional cells in the culture, exponentially infecting the entire cell culture population in a number of infection cycles that is a function of the initial multiplicity of infection, see Urabe, M. et al., J Virol. 2006 February; 80 (4):1874-85, the contents of which are herein incorporated by reference in their entirety.

Production of AAV particles with baculovirus in an insect cell system may address known baculovirus genetic and physical instability. In one embodiment, the production system addresses baculovirus instability over multiple passages by utilizing a titerless infected-cells preservation and scale-up system. Small scale seed cultures of viral producing cells are transfected with viral expression constructs encoding the structural, non-structural, components of the viral particle. Baculovirus-infected viral producing cells are harvested into aliquots that may be cryopreserved in liquid nitrogen; the aliquots retain viability and infectivity for infection of large scale viral producing cell culture Wasilko D J et al., Protein Expr Purif. 2009 June; 65(2):122-32, the contents of which are herein incorporated by reference in their entirety.

A genetically stable baculovirus may be used to produce source of the one or more of the components for producing AAV particles in invertebrate cells. In one embodiment, defective baculovirus expression vectors may be maintained episomally in insect cells. In such an embodiment the bacmid vector is engineered with replication control elements, including but not limited to promoters, enhancers, and/or cell-cycle regulated replication elements.

In one embodiment, baculoviruses may be engineered with a (non-) selectable marker for recombination into the chitinase/cathepsin locus. The chia/v-cath locus is non-essential for propagating baculovirus in tissue culture, and the V-cath (EC 3.4.22.50) is a cysteine endoprotease that is most active on Arg-Arg dipeptide containing substrates. The Arg-Arg dipeptide is present in densovirus and parvovirus capsid structural proteins but infrequently occurs in dependovirus VP1.

In one embodiment, stable viral replication cells permissive for baculovirus infection are engineered with at least one stable integrated copy of any of the elements necessary for AAV replication and viral particle production including, but not limited to, the entire AAV genome, Rep and Cap genes, Rep genes, Cap genes, each Rep protein as a separate transcription cassette, each VP protein as a separate transcription cassette, the AAP (assembly activation protein), or at least one of the baculovirus helper genes with native or non-native promoters.

Large-Scale Production

In some embodiments, AAV particle production may be modified to increase the scale of production. Large scale viral production methods according to the present disclosure may include any of those taught in U.S. Pat. Nos. 5,756,283, 6,258,595, 6,261,551, 6,270,996, 6,281,010, 6,365,394, 6,475,769, 6,482,634, 6,485,966, 6,943,019, 6,953,690, 7,022,519, 7,238,526, 7,291,498 and 7,491,508 or International Publication Nos. WO1996039530, WO1998010088, WO1999014354, WO1999015685, WO1999047691, WO2000055342, WO2000075353 and WO2001023597, the contents of each of which are herein incorporated by reference in their entirety. Methods of increasing viral particle production scale typically comprise increasing the number of viral replication cells. In some embodiments, viral replication cells comprise adherent cells. To increase the scale of viral particle production by adherent viral replication cells, larger cell culture surfaces are required. In some cases, large-scale production methods comprise the use of roller bottles to increase cell culture surfaces. Other cell culture substrates with increased surface areas are known in the art. Examples of additional adherent cell culture products with increased surface areas include, but are not limited to CELLSTACK®, CELLCUBE® (Corning Corp., Corning, N.Y.) and NUNC™ CELL FACTORY™ (Thermo Scientific, Waltham, Mass.) In some cases, large-scale adherent cell surfaces may comprise from about 1,000 $cm^2$ to about 100,000 cm$^2$. In some cases, large-scale adherent cell cultures may comprise from about $10^7$ to about $10^9$ cells, from about $10^8$ to about $10^{10}$ cells, from about $10^9$ to about $10^{12}$ cells or at least $10^{12}$ cells. In some cases, large-scale adherent cultures may produce from about $10^9$ to about $10^{12}$, from about $10^{10}$ to about $10^{13}$, from about $10^{11}$ to about $10^{14}$, from about $10^{12}$ to about $10^{15}$ or at least $10^{15}$ viral particles.

In some embodiments, large-scale viral production methods of the present disclosure may comprise the use of suspension cell cultures. Suspension cell culture allows for significantly increased numbers of cells. Typically, the number of adherent cells that can be grown on about 10-50 cm$^2$ of surface area can be grown in about 1 cm$^3$ volume in suspension.

Transfection of replication cells in large-scale culture formats may be carried out according to any methods known in the art. For large-scale adherent cell cultures, transfection methods may include, but are not limited to the use of inorganic compounds (e.g. calcium phosphate), organic compounds [e.g. polyethyleneimine (PEI)] or the use of non-chemical methods (e.g. electroporation.) With cells grown in suspension, transfection methods may include, but are not limited to the use of calcium phosphate and the use of PEI. In some cases, transfection of large scale suspension cultures may be carried out according to the section entitled "Transfection Procedure" described in Feng, L. et al., 2008. Biotechnol Appl. Biochem. 50:121-32, the contents of which are herein incorporated by reference in their entirety. According to such embodiments, PEI-DNA complexes may be formed for introduction of plasmids to be transfected. In some cases, cells being transfected with PEI-DNA complexes may be 'shocked' prior to transfection. This comprises lowering cell culture temperatures to 4° C. for a period of about 1 hour. In some cases, cell cultures may be shocked for a period of from about 10 minutes to about 5 hours. In some cases, cell cultures may be shocked at a temperature of from about 0° C. to about 20° C.

In some cases, transfections may include one or more vectors for expression of an RNA effector molecule to reduce expression of nucleic acids from one or more AAV payload construct. Such methods may enhance the production of viral particles by reducing cellular resources wasted on expressing payload constructs. In some cases, such methods may be carried according to those taught in US Publication No. US2014/0099666, the contents of which are herein incorporated by reference in their entirety.

Bioreactors

In some embodiments, cell culture bioreactors may be used for large scale viral production. In some cases, bioreactors comprise stirred tank reactors. Such reactors generally comprise a vessel, typically cylindrical in shape, with a stirrer (e.g. impeller.) In some embodiments, such bioreactor vessels may be placed within a water jacket to control vessel temperature and/or to minimize effects from ambient temperature changes. Bioreactor vessel volume may range in size from about 500 ml to about 2 L, from about 1 L to about 5 L, from about 2.5 L to about 20 L, from about 10 L to about 50 L, from about 25 L to about 100 L, from about 75 L to about 500 L, from about 250 L to about 2,000 L, from about 1,000 L to about 10,000 L, from about 5,000 L to about 50,000 L or at least 50,000 L. Vessel bottoms may be rounded or flat. In some cases, animal cell cultures may be maintained in bioreactors with rounded vessel bottoms.

In some cases, bioreactor vessels may be warmed through the use of a thermocirculator. Thermocirculators pump heated water around water jackets. In some cases, heated water may be pumped through pipes (e.g. coiled pipes) that are present within bioreactor vessels. In some cases, warm air may be circulated around bioreactors, including, but not limited to air space directly above culture medium. Additionally, pH and $CO_2$ levels may be maintained to optimize cell viability.

In some cases, bioreactors may comprise hollow-fiber reactors. Hollow-fiber bioreactors may support the culture of both anchorage dependent and anchorage independent cells. Further bioreactors may include, but are not limited to packed-bed or fixed-bed bioreactors. Such bioreactors may comprise vessels with glass beads for adherent cell attachment. Further packed-bed reactors may comprise ceramic beads.

In some cases, viral particles are produced through the use of a disposable bioreactor. In some embodiments, such bioreactors may include WAVE™ disposable bioreactors.

In some embodiments, AAV particle production in animal cell bioreactor cultures may be carried out according to the methods taught in U.S. Pat. Nos. 5,064,764, 6,194,191, 6,566,118, 8,137,948 or US Patent Application No. US2011/0229971, the contents of each of which are herein incorporated by reference in their entirety.

Cell Lysis

Cells of the invention, including, but not limited to viral production cells, may be subjected to cell lysis according to any methods known in the art. Cell lysis may be carried out to obtain one or more agents (e.g. viral particles) present within any cells of the invention. In some embodiments, cell lysis may be carried out according to any of the methods listed in U.S. Pat. Nos. 7,326,555, 7,579,181, 7,048,920, 6,410,300, 6,436,394, 7,732,129, 7,510,875, 7,445,930, 6,726,907, 6,194,191, 7,125,706, 6,995,006, 6,676,935, 7,968,333, 5,756,283, 6,258,595, 6,261,551, 6,270,996, 6,281,010, 6,365,394, 6,475,769, 6,482,634, 6,485,966, 6,943,019, 6,953,690, 7,022,519, 7,238,526, 7,291,498 and 7,491,508 or International Publication Nos. WO 1996039530, WO 1998010088, WO 1999014354, WO 1999015685, WO 1999047691, WO2000055342, WO2000075353 and WO2001023597, the contents of each of which are herein incorporated by reference in their entirety. Cell lysis methods may be chemical or mechanical. Chemical cell lysis typically comprises contacting one or more cells with one or more lysis agent. Mechanical lysis typically comprises subjecting one or more cells to one or more lysis condition and/or one or more lysis force.

In some embodiments, chemical lysis may be used to lyse cells. As used herein, the term "lysis agent" refers to any agent that may aid in the disruption of a cell. In some cases, lysis agents are introduced in solutions, termed lysis solutions or lysis buffers. As used herein, the term "lysis solution" refers to a solution (typically aqueous) comprising one or more lysis agent. In addition to lysis agents, lysis solutions may include one or more buffering agents, solubilizing agents, surfactants, preservatives, cryoprotectants, enzymes, enzyme inhibitors and/or chelators. Lysis buffers are lysis solutions comprising one or more buffering agent. Additional components of lysis solutions may include one or more solubilizing agent. As used herein, the term "solubilizing agent" refers to a compound that enhances the solubility of one or more components of a solution and/or the solubility of one or more entities to which solutions are applied. In some cases, solubilizing agents enhance protein solubility. In some cases, solubilizing agents are selected based on their ability to enhance protein solubility while maintaining protein conformation and/or activity.

Exemplary lysis agents may include any of those described in U.S. Pat. Nos. 8,685,734, 7,901,921, 7,732,129, 7,223,585, 7,125,706, 8,236,495, 8,110,351, 7,419,956, 7,300,797, 6,699,706 and 6,143,567, the contents of each of which are herein incorporated by reference in their entirety. In some cases, lysis agents may be selected from lysis salts, amphoteric agents, cationic agents, ionic detergents and non-ionic detergents. Lysis salts may include, but are not limited to sodium chloride (NaCl) and potassium chloride (KCl.) Further lysis salts may include any of those described in U.S. Pat. Nos. 8,614,101, 7,326,555, 7,579,181, 7,048, 920, 6,410,300, 6,436,394, 7,732,129, 7,510,875, 7,445,930, 6,726,907, 6,194,191, 7,125,706, 6,995,006, 6,676,935 and 7,968,333, the contents of each of which are herein incorporated by reference in their entirety. Concentrations of salts may be increased or decreased to obtain an effective concentration for rupture of cell membranes. Amphoteric agents, as referred to herein, are compounds capable of reacting as an acid or a base. Amphoteric agents may include, but are not limited to lysophosphatidylcholine, 3-((3-Cholamidopropyl) dimethylammonium)-1-propanesulfonate (CHAPS), ZWITTERGENT® and the like. Cationic agents may include, but are not limited to cetyltrimethylammonium bromide (C (16) TAB) and Benzalkonium chloride. Lysis agents comprising detergents may include ionic detergents or non-ionic detergents. Detergents may function to break apart or dissolve cell structures including, but not limited to cell membranes, cell walls, lipids, carbohydrates, lipoproteins and glycoproteins. Exemplary ionic detergents include any of those taught in U.S. Pat. Nos. 7,625,570 and 6,593,123 or US Publication No. US2014/0087361, the contents of each of which are herein incorporated by reference in their entirety. Some ionic detergents may include, but are not limited to sodium dodecyl sulfate (SDS), cholate and deoxycholate. In some cases, ionic detergents may be included in lysis solutions as a solubilizing agent. Non-ionic detergents may include, but are not limited to octylglucoside, digitonin, lubrol, C12E8, TWEEN®-20, TWEEN®-80, Triton X-100 and Noniodet P-40. Non-ionic detergents are typically weaker lysis agents, but may be included as solubilizing agents for solubilizing cellular and/or viral proteins. Further lysis agents may include enzymes and urea. In some cases, one or more lysis agents may be combined in a lysis solution in order to enhance one or more of cell lysis and protein solubility. In some cases, enzyme inhibitors may be included in lysis solutions in order to prevent proteolysis that may be triggered by cell membrane disruption.

In some embodiments, mechanical cell lysis is carried out. Mechanical cell lysis methods may include the use of one or more lysis condition and/or one or more lysis force. As used herein, the term "lysis condition" refers to a state or circumstance that promotes cellular disruption. Lysis conditions may comprise certain temperatures, pressures, osmotic purity, salinity and the like. In some cases, lysis conditions comprise increased or decreased temperatures. According to some embodiments, lysis conditions comprise changes in temperature to promote cellular disruption. Cell lysis carried out according to such embodiments may include freeze-thaw lysis. As used herein, the term "freeze-thaw lysis" refers to cellular lysis in which a cell solution is subjected to one or more freeze-thaw cycle. According to freeze-thaw lysis methods, cells in solution are frozen to induce a mechanical disruption of cellular membranes caused by the formation and expansion of ice crystals. Cell solutions used according freeze-thaw lysis methods, may further comprise one or more lysis agents, solubilizing agents, buffering agents, cryoprotectants, surfactants, preservatives, enzymes, enzyme inhibitors and/or chelators. Once cell solutions subjected to freezing are thawed, such components may enhance the recovery of desired cellular products. In some cases, one or more cryoprotectants are included in cell solutions undergoing freeze-thaw lysis. As used herein, the term "cryoprotectant" refers to an agent used to protect one or more substance from damage due to freezing. Cryoprotectants may include any of those taught in US Publication No. US2013/0323302 or U.S. Pat. Nos. 6,503,888, 6,180, 613, 7,888,096, 7,091,030, the contents of each of which are herein incorporated by reference in their entirety. In some cases, cryoprotectants may include, but are not limited to dimethyl sulfoxide, 1,2-propanediol, 2,3-butanediol, formamide, glycerol, ethylene glycol, 1,3-propanediol and n-dimethyl formamide, polyvinylpyrrolidone, hydroxyethyl starch, agarose, dextrans, inositol, glucose, hydroxyethylstarch, lactose, sorbitol, methyl glucose, sucrose and urea. In some embodiments, freeze-thaw lysis may be carried out according to any of the methods described in U.S. Pat. No. 7,704,721, the contents of which are herein incorporated by reference in their entirety.

As used herein, the term "lysis force" refers to a physical activity used to disrupt a cell. Lysis forces may include, but are not limited to mechanical forces, sonic forces, gravitational forces, optical forces, electrical forces and the like. Cell lysis carried out by mechanical force is referred to herein as "mechanical lysis." Mechanical forces that may be used according to mechanical lysis may include high shear fluid forces. According to such methods of mechanical lysis, a microfluidizer may be used. Microfluidizers typically comprise an inlet reservoir where cell solutions may be applied. Cell solutions may then be pumped into an interaction chamber via a pump (e.g. high-pressure pump) at high speed and/or pressure to produce shear fluid forces. Resulting lysates may then be collected in one or more output reservoir. Pump speed and/or pressure may be adjusted to modulate cell lysis and enhance recovery of products (e.g. viral particles.) Other mechanical lysis methods may include physical disruption of cells by scraping.

Cell lysis methods may be selected based on the cell culture format of cells to be lysed. For example, with adherent cell cultures, some chemical and mechanical lysis methods may be used. Such mechanical lysis methods may include freeze-thaw lysis or scraping. In another example, chemical lysis of adherent cell cultures may be carried out through incubation with lysis solutions comprising surfactant, such as Triton-X-100. In some cases, cell lysates generated from adherent cell cultures may be treated with one more nuclease to lower the viscosity of the lysates caused by liberated DNA.

In one embodiment, a method for harvesting AAV particles without lysis may be used for efficient and scalable AAV particle production. In a non-limiting example, AAV particles may be produced by culturing an AAV particle lacking a heparin binding site, thereby allowing the AAV particle to pass into the supernatant, in a cell culture, collecting supernatant from the culture; and isolating the AAV particle from the supernatant, as described in US Patent Application 20090275107, the contents of which are incorporated herein by reference in their entirety.

Clarification

Cell lysates comprising viral particles may be subjected to clarification. Clarification refers to initial steps taken in purification of viral particles from cell lysates. Clarification serves to prepare lysates for further purification by removing larger, insoluble debris. Clarification steps may include, but are not limited to centrifugation and filtration. During clarification, centrifugation may be carried out at low speeds to remove larger debris only. Similarly, filtration may be carried out using filters with larger pore sizes so that only larger debris is removed. In some cases, tangential flow filtration may be used during clarification. Objectives of viral clarification include high throughput processing of cell lysates and to optimize ultimate viral recovery. Advantages of including a clarification step include scalability for processing of larger volumes of lysate. In some embodiments, clarification may be carried out according to any of the methods presented in U.S. Pat. Nos. 8,524,446, 5,756,283, 6,258,595, 6,261,551, 6,270,996, 6,281,010, 6,365,394, 6,475,769, 6,482,634, 6,485,966, 6,943,019, 6,953,690, 7,022,519, 7,238,526, 7,291,498, 7,491,508, US Publication Nos. US2013/0045186, US2011/0263027, US2011/0151434, US2003/0138772, and International Publication Nos. WO2002012455, WO1996039530, WO1998010088, WO1999014354, WO1999015685, WO1999047691, WO2000055342, WO2000075353 and WO2001023597, the contents of each of which are herein incorporated by reference in their entirety.

Methods of cell lysate clarification by filtration are well understood in the art and may be carried out according to a variety of available methods including, but not limited to passive filtration and flow filtration. Filters used may comprise a variety of materials and pore sizes. For example, cell lysate filters may comprise pore sizes of from about 1 μM to about 5 μM, from about 0.5 μM to about 2 μM, from about 0.1 μM to about 1 μM, from about 0.05 μM to about 0.05 μM and from about 0.001 μM to about 0.1 μM. Exemplary pore sizes for cell lysate filters may include, but are not limited to, 2.0, 1.9, 1.8, 1.7, 1.6, 1.5, 1.4, 1.3, 1.2, 1.1, 1, 0.9, 0.8, 0.7, 0.6, 0.5, 0.4, 0.3, 0.2, 0.1, 0.95, 0.9, 0.85, 0.8, 0.75, 0.7, 0.65, 0.6, 0.55, 0.5, 0.45, 0.4, 0.35, 0.3, 0.25, 0.2, 0.15, 0.1, 0.05, 0.22, 0.21, 0.20, 0.19, 0.18, 0.17, 0.16, 0.15, 0.14, 0.13, 0.12, 0.11, 0.1, 0.09, 0.08, 0.07, 0.06, 0.05, 0.04, 0.03, 0.02, 0.01, 0.02, 0.019, 0.018, 0.017, 0.016, 0.015, 0.014, 0.013, 0.012, 0.011, 0.01, 0.009, 0.008, 0.007, 0.006, 0.005, 0.004, 0.003, 0.002, 0.001 and 0.001 μM. In one embodiment, clarification may comprise filtration through a filter with 2.0 μM pore size to remove large debris, followed by passage through a filter with 0.45 μM pore size to remove intact cells.

Filter materials may be composed of a variety of materials. Such materials may include, but are not limited to polymeric materials and metal materials (e.g. sintered metal and pored aluminum.) Exemplary materials may include, but are not limited to nylon, cellulose materials (e.g. cellulose acetate), polyvinylidene fluoride (PVDF), polyethersulfone, polyamide, polysulfone, polypropylene, and polyethylene terephthalate. In some cases, filters useful for clarification of cell lysates may include, but are not limited to ULTIPLEAT PROFILE™ filters (Pall Corporation, Port Washington, NY), SUPOR™ membrane filters (Pall Corporation, Port Washington, NY)

In some cases, flow filtration may be carried out to increase filtration speed and/or effectiveness. In some cases, flow filtration may comprise vacuum filtration. According to such methods, a vacuum is created on the side of the filter opposite that of cell lysate to be filtered. In some cases, cell lysates may be passed through filters by centrifugal forces. In some cases, a pump is used to force cell lysate through clarification filters. Flow rate of cell lysate through one or more filters may be modulated by adjusting one of channel size and/or fluid pressure.

According to some embodiments, cell lysates may be clarified by centrifugation. Centrifugation may be used to pellet insoluble particles in the lysate. During clarification, centrifugation strength [expressed in terms of gravitational units (g), which represents multiples of standard gravitational force] may be lower than in subsequent purification steps. In some cases, centrifugation may be carried out on cell lysates at from about 200 g to about 800 g, from about 500 g to about 1500 g, from about 1000 g to about 5000 g, from about 1200 g to about 10000 g or from about 8000 g to about 15000 g. In some embodiments, cell lysate centrifugation is carried out at 8000 g for 15 minutes. In some cases, density gradient centrifugation may be carried out in order to partition particulates in the cell lysate by sedimentation rate. Gradients used according to methods of the present disclosure may include, but are not limited to cesium chloride gradients and iodixanol step gradients.

Purification: Chromatography

In some cases, AAV particles may be purified from clarified cell lysates by one or more methods of chromatography. Chromatography refers to any number of methods known in the art for separating out one or more elements from a mixture. Such methods may include, but are not limited to ion exchange chromatography (e.g. cation exchange chromatography and anion exchange chromatography), immunoaffinity chromatography and size-exclusion chromatography. In some embodiments, methods of viral chromatography may include any of those taught in U.S. Pat. Nos. 5,756,283, 6,258,595, 6,261,551, 6,270,996, 6,281,010, 6,365,394, 6,475,769, 6,482,634, 6,485,966, 6,943,019, 6,953,690, 7,022,519, 7,238,526, 7,291,498 and 7,491,508 or International Publication Nos. WO1996039530, WO1998010088, WO 1999014354, WO 1999015685, WO 1999047691, WO2000055342, WO2000075353 and WO2001023597, the contents of each of which are herein incorporated by reference in their entirety.

In some embodiments, ion exchange chromatography may be used to isolate viral particles. Ion exchange chromatography is used to bind viral particles based on charge-charge interactions between capsid proteins and charged sites present on a stationary phase, typically a column through which viral preparations (e.g. clarified lysates) are passed. After application of viral preparations, bound viral particles may then be eluted by applying an elution solution to disrupt the charge-charge interactions. Elution solutions may be optimized by adjusting salt concentration and/or pH to enhance recovery of bound viral particles. Depending on the charge of viral capsids being isolated, cation or anion exchange chromatography methods may be selected. Methods of ion exchange chromatography may include, but are not limited to any of those taught in U.S. Pat. Nos. 7,419,817, 6,143,548, 7,094,604, 6,593,123, 7,015,026 and 8,137,948, the contents of each of which are herein incorporated by reference in their entirety.

In some embodiments, immunoaffinity chromatography may be used. Immunoaffinity chromatography is a form of chromatography that utilizes one or more immune compounds (e.g. antibodies or antibody-related structures) to retain viral particles. Immune compounds may bind specifically to one or more structures on viral particle surfaces, including, but not limited to one or more viral coat protein. In some cases, immune compounds may be specific for a particular viral variant. In some cases, immune compounds may bind to multiple viral variants. In some embodiments, immune compounds may include recombinant single-chain antibodies. Such recombinant single chain antibodies may include those described in Smith, R. H. et al., 2009. Mol. Ther. 17(11):1888-96, the contents of which are herein incorporated by reference in their entirety. Such immune compounds are capable of binding to several AAV capsid variants, including, but not limited to AAV1, AAV2, AAV6 and AAV8.

In some embodiments, size-exclusion chromatography (SEC) may be used. SEC may comprise the use of a gel to separate particles according to size. In viral particle purification, SEC filtration is sometimes referred to as "polishing." In some cases. SEC may be carried out to generate a final product that is near-homogenous. Such final products may in some cases be used in pre-clinical studies and/or clinical studies (Kotin, R. M. 2011. Human Molecular Genetics. 20(1):R2-R6, the contents of which are herein incorporated by reference in their entirety.) In some cases, SEC may be carried out according to any of the methods taught in U.S. Pat. Nos. 6,143,548, 7,015,026, 8,476,418, 6,410,300, 8,476,418, 7,419,817, 7,094,604, 6,593,123, and 8,137,948, the contents of each of which are herein incorporated by reference in their entirety.

In one embodiment, the compositions comprising at least one AAV particle may be isolated or purified using the methods described in U.S. Pat. No. 6,146,874, the contents of which are herein incorporated by reference in its entirety.

In one embodiment, the compositions comprising at least one AAV particle may be isolated or purified using the methods described in U.S. Pat. No. 6,660,514, the contents of which are herein incorporated by reference in its entirety.

In one embodiment, the compositions comprising at least one AAV particle may be isolated or purified using the methods described in U.S. Pat. No. 8,283,151, the contents of which are herein incorporated by reference in its entirety.

In one embodiment, the compositions comprising at least one AAV particle may be isolated or purified using the methods described in U.S. Pat. No. 8,524,446, the contents of which are herein incorporated by reference in its entirety.

II. Formulation and Delivery

Pharmaceutical Compositions and Formulation

In addition to the pharmaceutical compositions (AAV particles comprising a modulatory polynucleotide sequence encoding the siRNA molecules), provided herein are pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

In some embodiments, compositions are administered to humans, human patients or subjects. For the purposes of the present disclosure, the phrase "active ingredient" generally refers either to the synthetic siRNA duplexes, the modulatory polynucleotide encoding the siRNA duplex, or the AAV particle comprising a modulatory polynucleotide encoding the siRNA duplex described herein.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired single- or multi-dose unit.

Relative amounts of the active ingredient, the pharmaceutically acceptable excipient, and/or any additional ingredients in a pharmaceutical composition in accordance with the invention will vary, depending upon the identity, size, and/or condition of the subject treated and further depending upon the route by which the composition is to be administered.

The AAV particles comprising the modulatory polynucleotide sequence encoding the siRNA molecules of the present invention can be formulated using one or more excipients to: (1) increase stability; (2) increase cell transfection or transduction; (3) permit the sustained or delayed release; or (4) alter the biodistribution (e.g., target the AAV particle to specific tissues or cell types such as brain and neurons).

Formulations of the present invention can include, without limitation, saline, lipidoids, liposomes, lipid nanoparticles, polymers, lipoplexes, core-shell nanoparticles, peptides, proteins, cells transfected with AAV particles (e.g., for transplantation into a subject), nanoparticle mimics and combinations thereof. Further, the AAV particles of the present invention may be formulated using self-assembled nucleic acid nanoparticles.

Formulations of the pharmaceutical compositions described herein may be prepared by any method known or hereafter developed in the art of pharmacology. In general, such preparatory methods include the step of associating the active ingredient with an excipient and/or one or more other accessory ingredients.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, a pharmaceutically acceptable excipient may be at least 95%, at least 96%, at least 97%, at least 98%, at least 99%, or 100% pure. In some embodiments, an excipient is approved for use for humans and for veterinary use. In some embodiments, an excipient may be approved by United States Food and Drug Administration. In some embodiments, an excipient may be of pharmaceutical grade. In some embodiments, an excipient may meet the standards of the United States Pharmacopoeia (USP), the European Pharmacopoeia (EP), the British Pharmacopoeia, and/or the International Pharmacopoeia.

Excipients, which, as used herein, includes, but is not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21$^{st}$ Edition, A. R. Gennaro, Lippincott, Williams & Wilkins, Baltimore, Md., 2006; incorporated herein by reference in its entirety). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

In some embodiments, the formulations may comprise at least one inactive ingredient. As used herein, the term "inactive ingredient" refers to one or more inactive agents included in formulations. In some embodiments, all, none or some of the inactive ingredients which may be used in the formulations of the present invention may be approved by the US Food and Drug Administration (FDA).

Formulations of vectors comprising the nucleic acid sequence for the siRNA molecules of the present invention may include cations or anions. In one embodiment, the formulations include metal cations such as, but not limited to, Zn2+, Ca2+, Cu2+, Mg+ and combinations thereof.

As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentancpropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences*, 17$^{th}$ ed., Mack Publishing Company, Easton, Pa., 1985, p. 1418, *Pharmaceutical Salts: Properties. Selection, and Use*, P. H. Stahl and C. G. Wermuth (eds.), Wiley-VCH, 2008, and Berge et al., *Journal of Pharmaceutical Science*, 66, 1-19 (1977), the content of each of which is incorporated herein by reference in their entirety.

The term "pharmaceutically acceptable solvate," as used herein, means a compound of the invention wherein molecules of a suitable solvent are incorporated in the crystal lattice. A suitable solvent is physiologically tolerable at the dosage administered. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

According to the present invention, the AAV particle comprising the modulatory polynucleotide sequence encoding for the siRNA molecules may be formulated for CNS delivery. Agents that cross the brain blood barrier may be used. For example, some cell penetrating peptides that can target siRNA molecules to the brain blood barrier endothelium may be used to formulate the siRNA duplexes targeting the HTT gene.

Inactive Ingredients

In some embodiments, formulations may comprise at least one excipient which is an inactive ingredient. As used herein, the term "inactive ingredient" refers to one or more inactive agents included in formulations. In some embodiments, all, none or some of the inactive ingredients which may be used in the formulations of the present disclosure may be approved by the US Food and Drug Administration (FDA).

Formulations of AAV particles described herein may include cations or anions. In one embodiment, the formulations include metal cations such as, but not limited to, Zn2+, Ca2+, Cu2+, Mg+ and combinations thereof. As a non-limiting example, formulations may include polymers and compositions described herein complexed with a metal cation (See e.g., U.S. Pat. Nos. 6,265,389 and 6,555,525, each of which is herein incorporated by reference in its entirety).

Delivery

In one embodiment, the AAV particles described herein may be administered or delivered using the methods for the delivery of AAV virions described in European Patent Application No. EP1857552, the contents of which are herein incorporated by reference in its entirety.

In one embodiment, the AAV particles described herein may be administered or delivered using the methods for delivering proteins using AAV vectors described in European Patent Application No. EP2678433, the contents of which are herein incorporated by reference in its entirety.

In one embodiment, the AAV particle described herein may be administered or delivered using the methods for delivering DNA molecules using AAV vectors described in U.S. Pat. No. 5,858,351, the contents of which are herein incorporated by reference in its entirety.

In one embodiment, the AAV particle described herein may be administered or delivered using the methods for delivering DNA to the bloodstream described in U.S. Pat. No. 6,211,163, the contents of which are herein incorporated by reference in its entirety.

In one embodiment, the AAV particle described herein may be administered or delivered using the methods for delivering AAV virions described in U.S. Pat. No. 6,325,998, the contents of which are herein incorporated by reference in its entirety.

In one embodiment, the AAV particle described herein may be administered or delivered using the methods for delivering a payload to the central nervous system described in U.S. Pat. No. 7,588,757, the contents of which are herein incorporated by reference in its entirety.

In one embodiment, the AAV particle described herein may be administered or delivered using the methods for delivering a payload described in U.S. Pat. No. 8,283,151, the contents of which are herein incorporated by reference in its entirety.

In one embodiment, the AAV particle described herein may be administered or delivered using the methods for delivering a payload using a glutamic acid decarboxylase (GAD) delivery vector described in International Patent Publication No. WO2001089583, the contents of which are herein incorporated by reference in its entirety.

In one embodiment, the AAV particle described herein may be administered or delivered using the methods for delivering a payload to neural cells described in International Patent Publication No. WO2012057363, the contents of which are herein incorporated by reference in its entirety.

Delivery to Cells

The present disclosure provides a method of delivering to a cell or tissue any of the above-described AAV polynucleotides or AAV genomes, comprising contacting the cell or tissue with said AAV polynucleotide or AAV genomes or contacting the cell or tissue with a particle comprising said AAV polynucleotide or AAV genome, or contacting the cell or tissue with any of the described compositions, including pharmaceutical compositions. The method of delivering the AAV polynucleotide or AAV genome to a cell or tissue can be accomplished in vitro, ex vivo, or in vivo.

Introduction into Cells—Synthetic dsRNA

To ensure the chemical and biological stability of siRNA molecules (e.g., siRNA duplexes and dsRNA), it is important to deliver siRNA molecules inside the target cells. In some embodiments, the cells may include, but are not limited to, cells of mammalian origin, cells of human origins, embryonic stem cells, induced pluripotent stem cells, neural stem cells, and neural progenitor cells.

Nucleic acids, including siRNA, carry a net negative charge on the sugar-phosphate backbone under normal physiological conditions. In order to enter the cell, a siRNA molecule must come into contact with a lipid bilayer of the cell membrane, whose head groups are also negatively charged.

The siRNA duplexes can be complexed with a carrier that allows them to traverse cell membranes such as package particles to facilitate cellular uptake of the siRNA. The package particles may include, but are not limited to, liposomes, nanoparticles, cationic lipids, polyethylenimine derivatives, dendrimers, carbon nanotubes and the combination of carbon-made nanoparticles with dendrimers. Lipids may be cationic lipids and/or neutral lipids. In addition to well established lipophilic complexes between siRNA molecules and cationic carriers, siRNA molecules can be conjugated to a hydrophobic moiety, such as cholesterol (e.g., U.S. Patent Publication No. 20110110937; the content of which is herein incorporated by reference in its entirety). This delivery method holds a potential of improving m vitro cellular uptake and in vivo pharmacological properties of siRNA molecules. The siRNA molecules of the present invention may also be conjugated to certain cationic cell-penetrating peptides (CPPs), such as MPG, transportan or penetratin covalently or non-covalently (e.g., U.S. Patent Publication No. 20110086425; the content of which is herein incorporated by reference in its entirety).

Introduction into Cells—AAV Particles

The siRNA molecules (e.g., siRNA duplexes) of the present invention may be introduced into cells using any of a variety of approaches such as, but not limited to, AAV particles. These AAV particles are engineered and optimized to facilitate the entry of siRNA molecule into cells that are not readily amendable to transfection. Also, some synthetic AAV particles possess an ability to integrate the shRNA into the cell genome, thereby leading to stable siRNA expression and long-term knockdown of a target gene. In this manner, AAV particles are engineered as vehicles for specific delivery while lacking the deleterious replication and/or integration features found in wild-type virus.

In some embodiments, the siRNA molecules of the present invention are introduced into a cell by contacting the cell with an AAV particle comprising a modulatory polynucleotide sequence encoding a siRNA molecule, and a lipophilic carrier. In other embodiments, the siRNA molecule is introduced into a cell by transfecting or infecting the cell with an AAV particle comprising a nucleic acid sequence capable of producing the siRNA molecule when transcribed in the cell. In some embodiments, the siRNA molecule is introduced into a cell by injecting into the cell an AAV particle comprising a nucleic acid sequence capable of producing the siRNA molecule when transcribed in the cell.

In some embodiments, prior to transfection, an AAV particle comprising a nucleic acid sequence encoding the siRNA molecules of the present invention may be transfected into cells.

In other embodiments, the AAV particles comprising the nucleic acid sequence encoding the siRNA molecules of the present invention may be delivered into cells by electroporation (e.g. U.S. Patent Publication No. 20050014264; the content of which is herein incorporated by reference in its entirety).

Other methods for introducing AAV particles comprising the nucleic acid sequence encoding the siRNA molecules described herein may include photochemical internalization as described in U.S. Patent publication No. 20120264807; the content of which is herein incorporated by reference in its entirety.

In some embodiments, the formulations described herein may contain at least one AAV particle comprising the nucleic acid sequence encoding the siRNA molecules described herein. In one embodiment, the siRNA molecules may target the HTT gene at one target site. In another embodiment, the formulation comprises a plurality of AAV particles, each AAV particle comprising a nucleic acid sequence encoding a siRNA molecule targeting the HTT gene at a different target site. The HTT may be targeted at 2, 3, 4, 5 or more than 5 sites.

In one embodiment, the AAV particles from any relevant species, such as, but not limited to, human, dog, mouse, rat or monkey may be introduced into cells.

In one embodiment, the AAV particles may be introduced into cells which are relevant to the disease to be treated. As a non-limiting example, the disease is HD and the target cells are neurons and astrocytes. As another non-limiting example, the disease is HD and the target cells are medium spiny neurons, cortical neurons and astrocytes.

In one embodiment, the AAV particles may be introduced into cells which have a high level of endogenous expression of the target sequence.

In another embodiment, the AAV particles may be introduced into cells which have a low level of endogenous expression of the target sequence.

In one embodiment, the cells may be those which have a high efficiency of AAV transduction.

Delivery to Subjects

The present disclosure additionally provides a method of delivering to a subject, including a mammalian subject, any of the above-described AAV polynucleotides or AAV genomes comprising administering to the subject said AAV polynucleotide or AAV genome, or administering to the subject a particle comprising said AAV polynucleotide or AAV genome, or administering to the subject any of the described compositions, including pharmaceutical compositions.

The pharmaceutical compositions of AAV particles described herein may be characterized by one or more of bioavailability, therapeutic window and/or volume of distribution.

III. Administration and Dosing

Administration

The AAV particles comprising a nucleic acid sequence encoding the siRNA molecules of the present invention may be administered by any route which results in a therapeutically effective outcome. These include, but are not limited to, within the parenchyma of an organ such as, but not limited to, a brain (e.g., intraparenchymal), corpus striatum (intrastriatal), enteral (into the intestine), gastroenteral, epidural, oral (by way of the mouth), transdermal, peridural, intracerebral (into the cerebrum), intracerebroventricular (into the cerebral ventricles), subpial (under the pia), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraganglionic (into the ganglion), intraperitoneal, (infusion or injection into the peritoneum), intravesical infusion, intravitreal, (through the eye), intravenous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electroosmosis, endocervical, endosinusial, endotracheal, extracorporeal, hemodialysis, infiltration, interstitial, intraabdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavemosum (within the dilatable spaces of the corpus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intrailcal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intraocular (within the eye), intraovarian (within the ovary), intraperitoneal (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal.

In specific embodiments, compositions of AAV particles comprising a nucleic acid sequence encoding the siRNA molecules of the present invention may be administered in a way which facilitates the vectors or siRNA molecule to enter the central nervous system and penetrate into medium spiny and/or cortical neurons and/or astrocytes.

In some embodiments, the AAV particles comprising a nucleic acid sequence encoding the siRNA molecules of the present invention may be administered by intramuscular injection.

In one embodiment, the AAV particles comprising a nucleic acid sequence encoding the siRNA molecules of the present invention may be administered via intraparenchymal injection.

In one embodiment, the AAV particles comprising a nucleic acid sequence encoding the siRNA molecules of the present invention may be administered via intraparenchymal injection and intrathecal injection.

In one embodiment, the AAV particles comprising a nucleic acid sequence encoding the siRNA molecules of the present invention may be administered via intrastriatal injection.

In one embodiment, the AAV particles comprising a nucleic acid sequence encoding the siRNA molecules of the present invention may be administered via intrastriatal injection and another route of administration described herein.

In some embodiments, AAV particles that express siRNA duplexes of the present invention may be administered to a subject by peripheral injections (e.g., intravenous) and/or intranasal delivery. It was disclosed in the art that the peripheral administration of AAV particles for siRNA duplexes can be transported to the central nervous system, for example, to the neurons (e.g., U.S. Patent Publication Nos. 20100240739; and 20100130594; the content of each of which is incorporated herein by reference in their entirety).

In other embodiments, compositions comprising at least one AAV particle comprising a nucleic acid sequence encoding the siRNA molecules of the present invention may be administered to a subject by intracranial delivery (See, e.g., U.S. Pat. No. 8,119,611; the content of which is incorporated herein by reference in its entirety).

The AAV particle comprising a nucleic acid sequence encoding the siRNA molecules of the present invention may be administered in any suitable form, either as a liquid solution or suspension, as a solid form suitable for liquid solution or suspension in a liquid solution. The siRNA duplexes may be formulated with any appropriate and pharmaceutically acceptable excipient.

The AAV particle comprising a nucleic acid sequence encoding the siRNA molecules of the present invention may be administered in a "therapeutically effective" amount, i.e., an amount that is sufficient to alleviate and/or prevent at least one symptom associated with the disease, or provide improvement in the condition of the subject.

In one embodiment, the AAV particle may be administered to the CNS in a therapeutically effective amount to improve function and/or survival for a subject with Huntington's Disease (HD). As a non-limiting example, the vector may be administered by direct infusion into the striatum.

In one embodiment, the AAV particle may be administered to a subject (e.g., to the CNS of a subject via intrathecal administration) in a therapeutically effective amount for the siRNA duplexes or dsRNA to target the medium spiny neurons, cortical neurons and/or astrocytes. As a non-limiting example, the siRNA duplexes or dsRNA may reduce the expression of HTT protein or mRNA. As another non-limiting example, the siRNA duplexes or dsRNA can suppress HTT and reduce HTT mediated toxicity. The reduction of HTT protein and/or mRNA as well as HTT mediated toxicity may be accomplished with almost no enhanced inflammation.

In one embodiment, the AAV particle may be administered to a subject (e.g., to the CNS of a subject) in a therapeutically effective amount to slow the functional decline of a subject (e.g., determined using a known evaluation method such as the unified Huntington's disease rating scale (UHDRS)). As a non-limiting example, the vector may be administered via intraparenchymal injection.

In one embodiment, the AAV particle may be administered to the cisterna magna in a therapeutically effective amount to transduce medium spiny neurons, cortical neurons and/or astrocytes. As a non-limiting example, the vector may be administered intrathecally.

In one embodiment, the AAV particle may be administered using intrathecal infusion in a therapeutically effective amount to transduce medium spiny neurons, cortical neurons and/or astrocytes. As a non-limiting example, the vector may be administered intrathecally.

In one embodiment, the AAV particle may be administered to the cisterna magna in a therapeutically effective amount to transduce medium spiny neurons, cortical neurons and/or astrocytes. As a non-limiting example, the vector may be administered by intraparenchymal injection.

In one embodiment, the AAV particle comprising a modulatory polynucleotide may be formulated. As a non-limiting example the baricity and/or osmolality of the formulation may be optimized to ensure optimal drug distribution in the central nervous system or a region or component of the central nervous system.

In one embodiment, the AAV particle comprising a modulatory polynucleotide may be delivered to a subject via a single route administration.

In one embodiment, the AAV particle comprising a modulatory polynucleotide may be delivered to a subject via a multi-site route of administration. A subject may be administered the AAV particle comprising a modulatory polynucleotide at 2, 3, 4, 5 or more than 5 sites.

In one embodiment, a subject may be administered the AAV particle comprising a modulatory polynucleotide described herein using a bolus injection.

In one embodiment, a subject may be administered the AAV particle comprising a modulatory polynucleotide described herein using sustained delivery over a period of minutes, hours or days. The infusion rate may be changed depending on the subject, distribution, formulation or another delivery parameter.

In one embodiment, the AAV particle described herein is administered via putamen and caudate infusion. As a non-limiting example, the dual infusion provides a broad striatal distribution as well as a frontal and temporal cortical distribution.

In one embodiment, the AAV particle is AAV-DJ8 which is administered via unilateral putamen infusion. As a non-limiting example, the distribution of the administered AAV-DJ8 is similar to the distribution of AAV1 delivered via unilateral putamen infusion.

In one embodiment, the AAV particle described herein is administered via intrathecal (IT) infusion at C1. The infusion may be for 1, 2, 3, 4, 6, 7, 8, 9, 10, 11, 12, 13, 14, 15 or more than 15 hours.

In one embodiment, the selection of subjects for administration of the AAV particle described herein and/or the effectiveness of the dose, route of administration and/or volume of administration may be evaluated using imaging of the perivascular spaces (PVS) which are also known as Virchow-Robin spaces. PVS surround the arterioles and venules as they perforate brain parenchyma and are filled with cerebrospinal fluid (CSF)/interstitial fluid. PVS are common in the midbrain, basal ganglia, and centrum semiovale. While not wishing to be bound by theory, PVS may play a role in the normal clearance of metabolites and have been associated with worse cognition and several disease states including Parkinson's disease. PVS are usually are normal in size but they can increase in size in a number of disease states. Potter et al. (Cerebrovase Dis. 2015 January, 39(4): 224-231; the contents of which are herein incorporated by reference in its entirety) developed a grading method where they studied a full range of PVS and rated basal ganglia, centrum semiovale and midbrain PVS. They used the frequency and range of PVS used by Mac and Lullich et al. (J Neurol Neurosurg Psychiatry. 2004 November; 75(11):1519-23; the contents of which are herein incorporated by reference in its entirety) and Potter et al. gave 5 ratings to basal ganglia and centrum semiovale PVS: 0 (none), 1 (1-10), 2 (11-20), 3 (21-40) and 4 (>40) and 2 ratings to midbrain PVS: 0 (non visible) or 1 (visible). The user guide for the rating system by Potter et al. can be found at: www.sbirc.ed.ac.uk/documents/epvs-rating-scale-user-guide.pdf.

Dosing

The pharmaceutical compositions of the present invention may be administered to a subject using any amount effective for reducing, preventing and/or treating a HTT associated disorder (e.g., Huntington' Disease (HD)). The exact amount required will vary from subject to subject, depending on the species, age, and general condition of the subject, the severity of the disease, the particular composition, its mode of administration, its mode of activity, and the like.

The compositions of the present invention are typically formulated in unit dosage form for ease of administration and uniformity of dosage. It will be understood, however, that the total daily usage of the compositions of the present invention may be decided by the attending physician within the scope of sound medical judgment. The specific therapeutic effectiveness for any particular patient will depend upon a variety of factors including the disorder being treated and the severity of the disorder; the activity of the specific compound employed; the specific composition employed, the age, body weight, general health, sex and diet of the patient; the time of administration, route of administration, and rate of excretion of the siRNA duplexes employed; the duration of the treatment; drugs used in combination or coincidental with the specific compound employed; and like factors well known in the medical arts.

In one embodiment, the age and sex of a subject may be used to determine the dose of the compositions of the present invention. As a non-limiting example, a subject who is older may receive a larger dose (e.g., 5-10%, 10-20%, 15-30%, 20-50%, 25-50% or at least 1%, 2%, 3%, 4%, 5%, 10%, 20%, 30%, 40%, 50%, 60%, 70%, 80%, 90% or more than 90% more) of the composition as compared to a younger subject. As another non-limiting example, a subject who is younger may receive a larger dose (e.g., 5-10%, 10-20%, 15-30%, 20-50%, 25-50% or at least 1%, 2%, 3%, 4%, 5%, 10%, 20%, 30%, 40%, 50%, 60%, 70%, 80%, 90% or more than 90% more) of the composition as compared to an older subject. As yet another non-limiting example, a subject who is female may receive a larger dose (e.g., 5-10%, 10-20%, 15-30%,20-50%, 25-50% or at least 1%, 2%, 3%, 4%, 5%, 10%, 20%, 30%, 40%, 50%, 60%, 70%, 80%, 90% or more than 90% more) of the composition as compared to a male subject. As yet another non-limiting example, a subject who is male may receive a larger dose (e.g., 5-10%, 10-20%, 15-30%, 20-50%, 25-50% or at least 1%, 2%, 3%, 4%, 5%, 10%, 20%, 30%, 40%, 50%, 60%, 70%, 80%, 90% or more than 90% more) of the composition as compared to a female subject In some specific embodiments, the doses of AAV particles for delivering siRNA duplexes of the present invention may be adapted depending on the disease condition, the subject and the treatment strategy.

In one embodiment, delivery of the compositions in accordance with the present invention to cells comprises a rate of delivery defined by [VG/hour=mL/hour*VG/mL] wherein VG is viral genomes, VG/mL is composition concentration, and mL/hour is rate of prolonged delivery.

In one embodiment, delivery of compositions in accordance with the present invention to cells may comprise a total concentration per subject between about $1\times10^6$ VG and about $1\times10^{16}$ VG. In some embodiments, delivery may comprise a composition concentration of about $1\times10^6$, $2\times10^6$, $3\times10^6$, $4\times10^6$, $5\times10^6$, $6\times10^6$, $7\times10^6$, $8\times10^6$, $9\times10^6$, $1\times10^7$, $2\times10^7$, $3\times10^7$, $4\times10^7$, $5\times10^7$, $6\times10^7$, $7\times10^7$, $8\times10^7$, $9\times10^7$, $1\times10^8$, $2\times10^8$, $3\times10^8$, $4\times10^8$, $5\times10^8$, $6\times10^8$, $7\times10^8$, $8\times10^8$, $9\times10^8$, $1\times10^9$, $2\times10^9$, $3\times10^9$, $4\times10^9$, $5\times10^9$, $6\times10^9$, $7\times10^9$, $8\times10^9$, $9\times10^9$, $1\times10^{10}$, $2\times10^{10}$, $3\times10^{10}$, $4\times10^{10}$, $5\times10^{10}$, $6\times10^{10}$, $7\times10^{10}$, $8\times10^{10}$, $9\times10^{10}$, $1\times10^{11}$, $1.1\times10^{11}$, $1.2\times10^{11}$, $1.3\times10^{11}$, $1.4\times10^{11}$, $1.5\times10^{11}$, $1.6\times10^{11}$, $1.7\times10^{11}$, $1.8\times10^{11}$, $1.9\times10^{11}$, $2\times10^{11}$, $2.1\times10^{11}$, $2.2\times10^{11}$, $2.3\times10^{11}$, $2.4\times10^{11}$, $2.5\times10^{11}$, $2.6\times10^{11}$, $2.7\times10^{11}$, $2.8\times10^{11}$, $2.9\times10^{11}$, $3\times10^{11}$, $4\times10^{11}$, $5\times10^{11}$, $6\times10^{11}$, $7\times10^{11}$, $7.1\times10^{11}$, $7.2\times10^{11}$, $7.3\times10^{11}$, $7.4\times10^{11}$, $7.5\times10^{11}$, $7.6\times10^{11}$, $7.7\times10^{11}$, $7.8\times10^{11}$, $7.9\times10^{11}$, $8\times10^{11}$, $9\times10^{11}$, $1\times10^{12}$, $1.1\times10^{12}$, $1.2\times10^{12}$, $1.3\times10^{12}$, $1.4\times10^{12}$, $1.5\times10^{12}$, $1.6\times10^{12}$, $1.7\times10^{12}$, $1.8\times10^{12}$, $1.9\times10^{12}$, $2\times10^{12}$, $2.1\times10^{12}$, $2.2\times10^{12}$, $2.3\times10^{12}$, $2.4\times10^{12}$, $2.5\times10^{12}$, $2.6\times10^{12}$, $2.7\times10^{12}$, $2.8\times10^{12}$, $2.9\times10^{12}$, $3\times10^{12}$, $3.1\times10^{12}$, $3.2\times10^{12}$, $3.3\times10^{12}$, $3.4\times10^{12}$, $3.5\times10^{12}$, $3.6\times10^{12}$, $3.7\times10^{12}$, $3.8\times10^{12}$, $3.9\times10^{12}$, $4\times10^{12}$, $4.1\times10^{12}$, $4.2\times10^{12}$, $4.3\times10^{12}$, $4.4\times10^{12}$, $4.5\times10^{12}$, $4.6\times10^{12}$, $4.7\times10^{12}$, $4.8\times10^{12}$, $4.9\times10^{12}$, $5\times10^{12}$, $6\times10^{12}$, $6.1\times10^{12}$, $6.2\times10^{12}$, $6.3\times10^{12}$, $6.4\times10^{12}$, $6.5\times10^{12}$, $6.6\times10^{12}$, $6.7\times10^{12}$, $6.8\times10^{12}$, $6.9\times10^{12}$, $7\times10^{12}$, $8\times10^{12}$, $8.1\times10^{12}$, $8.2\times10^{12}$, $8.3\times10^{12}$, $8.4\times10^{12}$, $8.5\times10^{12}$, $8.6\times10^{12}$, $8.7\times10^{12}$, $8.8\times10^{12}$, $8.9\times10^{12}$, $9\times10^{12}$, $1\times10^{13}$, $1.1\times10^{13}$, $1.2\times10^{13}$, $1.3\times10^{13}$, $1.4\times10^{13}$, $1.5\times10^{13}$, $1.6\times10^{13}$, $1.7\times10^{13}$, $1.8\times10^{13}$, $1.9\times10^{13}$, $2\times10^{13}$, $3\times10^{13}$, $4\times10^{13}$, $5\times10^{13}$, $6\times10^{13}$, $6.7\times10^{13}$, $7\times10^{13}$, $8\times10^{13}$, $9\times10^{13}$, $1\times10^{14}$, $2\times10^{14}$, $3\times10^{14}$, $4\times10^{14}$, $5\times10^{14}$, $6\times10^{14}$, $7\times10^{14}$, $8\times10^{14}$, $9\times10^{14}$, $1\times10^{15}$, $2\times10^{15}$, $3\times10^{15}$, $4\times10^{15}$, $5\times10^{15}$, $6\times10^{15}$, $7\times10^{15}$, $8\times10^{15}$, $9\times10^{15}$, or $1\times10^{16}$ VG/subject.

In one embodiment, delivery of compositions in accordance with the present invention to cells may comprise a total concentration per subject between about $1\times10^6$ VG/kg and about $1\times10^{16}$ VG/kg. In some embodiments, delivery may comprise a composition concentration of about $1\times10^6$, $2\times10^6$, $3\times10^6$, $4\times10^6$, $5\times10^6$, $6\times10^6$, $7\times10^6$, $8\times10^6$, $9\times10^6$, $1\times10^7$, $2\times10^7$, $3\times10^7$, $4\times10^7$, $5\times10^7$, $6\times10^7$, $7\times10^7$, $8\times10^7$, $9\times10^7$, $1\times10^8$, $2\times10^8$, $3\times10^8$, $4\times10^8$, $5\times10^8$, $6\times10^8$, $7\times10^8$, $8\times10^8$, $9\times10^8$, $1\times10^9$, $2\times10^9$, $3\times10^9$, $4\times10^9$, $5\times10^9$, $6\times10^9$, $7\times10^9$, $8\times10^9$, $9\times10^9$, $1\times10^{10}$, $2\times10^{10}$, $3\times10^{10}$, $4\times10^{10}$, $5\times10^{10}$, $6\times10^{10}$, $7\times10^{10}$, $8\times10^{10}$, $9\times10^{10}$, $1\times10^{11}$, $1.1\times10^{11}$, $1.2\times10^{11}$, $1.3\times10^{11}$, $1.4\times10^{11}$, $1.5\times10^{11}$, $1.6\times10^{11}$, $1.7\times10^{11}$, $1.8\times10^{11}$, $1.9\times10^{11}$, $2\times10^{11}$, $2.1\times10^{11}$, $2.2\times10^{11}$, $2.3\times10^{11}$, $2.4\times10^{11}$, $2.5\times10^{11}$, $2.6\times10^{11}$, $2.7\times10^{11}$, $2.8\times10^{11}$, $2.9\times10^{11}$, $3\times10^{11}$, $4\times10^{11}$, $5\times10^{11}$, $6\times10^{11}$, $7\times10^{11}$, $7.1\times10^{11}$, $7.2\times10^{11}$, $7.3\times10^{11}$, $7.4\times10^{11}$, $7.5\times10^{11}$, $7.6\times10^{11}$, $7.7\times10^{11}$, $7.8\times10^{11}$, $7.9\times10^{11}$, $8\times10^{11}$, $9\times10^{11}$, $1\times10^{12}$, $1.1\times10^{12}$, $1.2\times10^{12}$, $1.3\times10^{12}$, $1.4\times10^{12}$, $1.5\times10^{12}$, $1.6\times10^{12}$, $1.7\times10^{12}$, $1.8\times10^{12}$, $1.9\times10^{12}$, $2\times10^{12}$, $2.1\times10^{12}$, $2.2\times10^{12}$, $2.3\times10^{12}$, $2.4\times10^{12}$, $2.5\times10^{12}$, $2.6\times10^{12}$, $2.7\times10^{12}$, $2.8\times10^{12}$, $2.9\times10^{12}$, $3\times10^{12}$, $3.1\times10^{12}$, $3.2\times10^{12}$, $3.3\times10^{12}$, $3.4\times10^{12}$, $3.5\times10^{12}$, $3.6\times10^{12}$, $3.7\times10^{12}$, $3.8\times10^{12}$, $3.9\times10^{12}$, $4\times10^{12}$, $4.1\times10^{12}$, $4.2\times10^{12}$, $4.3\times10^{12}$, $4.4\times10^{12}$, $4.5\times10^{12}$, $4.6\times10^{12}$, $4.7\times10^{12}$, $4.8\times10^{12}$, $4.9\times10^{12}$, $5\times10^{12}$, $6\times10^{12}$, $6.1\times10^{12}$, $6.2\times10^{12}$, $6.3\times10^{12}$, $6.4\times10^{12}$, $6.5\times10^{12}$, $6.6\times10^{12}$, $6.7\times10^{12}$, $6.8\times10^{12}$, $6.9\times10^{12}$, $7\times10^{12}$, $8\times10^{12}$, $8.1\times10^{12}$, $8.2\times10^{12}$, $8.3\times10^{12}$, $8.4\times10^{12}$, $8.5\times10^{12}$, $8.6\times10^{12}$, $8.7\times10^{12}$, $8.8\times10^{12}$, $8.9\times10^{12}$, $9\times10^{12}$, $1\times10^{13}$, $1.1\times10^{13}$, $1.2\times10^{13}$, $1.3\times10^{13}$, $1.4\times10^{13}$, $1.5\times10^{13}$, $1.6\times10^{13}$, $1.7\times10^{13}$, $1.8\times10^{13}$, $1.9\times10^{13}$, $2\times10^{13}$, $3\times10^{13}$, $4\times10^{13}$, $5\times10^{13}$, $6\times10^{13}$, $6.7\times10^{13}$, $7\times10^{13}$, $8\times10^{13}$, $9\times10^{13}$, $1\times10^{14}$, $2\times10^{14}$, $3\times10^{14}$, $4\times10^{14}$, $5\times10^{14}$, $6\times10^{14}$, $7\times10^{14}$, $8\times10^{14}$, $9\times10^{14}$, $1\times10^{15}$, $2\times10^{15}$, $3\times10^{15}$, $4\times10^{15}$, $5\times10^{15}$, $6\times10^{15}$, $7\times10^{15}$, $8\times10^{15}$, $9\times10^{15}$, or $1\times10^{16}$ VG/kg.

In one embodiment, about $10^5$ to $10^6$ viral genome (unit) may be administered per dose.

In one embodiment, delivery of the compositions in accordance with the present invention to cells may comprise a total concentration between about $1\times10^6$ VG/mL and about $1\times10^{16}$ VG/mL. In some embodiments, delivery may comprise a composition concentration of about $1\times10^6$, $2\times10^6$, $3\times10^6$, $4\times10^6$, $5\times10^6$, $6\times10^6$, $7\times10^6$, $8\times10^6$, $9\times10^6$, $1\times10^7$, $2\times10^7$, $3\times10^7$, $4\times10^7$, $5\times10^7$, $6\times10^7$, $7\times10^7$, $8\times10^7$, $9\times10^7$, $1\times10^8$, $2\times10^8$, $3\times10^8$, $4\times10^8$, $5\times10^8$, $6\times10^8$, $7\times10^8$, $8\times10^8$, $9\times10^8$, $1\times10^9$, $2\times10^9$, $3\times10^9$, $4\times10^9$, $5\times10^9$, $6\times10^9$, $7\times10^9$, $8\times10^9$, $9\times10^9$, $1\times10^{10}$, $2\times10^{10}$, $3\times10^{10}$, $4\times10^{10}$, $5\times10^{10}$, $6\times10^{10}$, $7\times10^{10}$, $8\times10^{10}$, $9\times10^{10}$, $1\times10^{11}$, $1.1\times10^{11}$, $1.2\times10^{11}$, $1.3\times10^{11}$, $1.4\times10^{11}$, $1.5\times10^{11}$, $1.6\times10^{11}$, $1.7\times10^{11}$, $1.8\times10^{11}$, $1.9\times10^{11}$, $2\times10^{11}$, $3\times10^{11}$, $4\times10^{11}$, $5\times10^{11}$, $6\times10^{11}$, $7\times10^{11}$, $8\times10^{11}$, $9\times10^{11}$, $1\times10^{12}$, $1.1\times10^{12}$, $1.2\times10^{12}$, $1.3\times10^{12}$, $1.4\times10^{12}$, $1.5\times10^{12}$, $1.6\times10^{12}$, $1.7\times10^{12}$, $1.8\times10^{12}$, $1.9\times10^{12}$, $2\times10^{12}$, $2.1\times10^{12}$, $2.2\times10^{12}$, $2.3\times10^{12}$, $2.4\times10^{12}$, $2.5\times10^{12}$, $2.6\times10^{12}$, $2.7\times10^{12}$, $2.8\times10^{12}$, $2.9\times10^{12}$, $3\times10^{12}$, $3.1\times10^{12}$, $3.2\times10^{12}$, $3.3\times10^{12}$, $3.4\times10^{12}$, $3.5\times10^{12}$, $3.6\times10^{12}$, $3.7\times10^{12}$, $3.8\times10^{12}$, $3.9\times10^{12}$, $4\times10^{12}$, $4.1\times10^{12}$, $4.2\times10^{12}$, $4.3\times10^{12}$, $4.4\times10^{12}$, $4.5\times10^{12}$, $4.6\times10^{12}$, $4.7\times10^{12}$, $4.8\times10^{12}$, $4.9\times10^{12}$, $5\times10^{12}$, $6\times10^{12}$, $6.1\times10^{12}$, $6.2\times10^{12}$, $6.3\times10^{12}$, $6.4\times10^{12}$, $6.5\times10^{12}$, $6.6\times10^{12}$, $6.7\times10^{12}$, $6.8\times10^{12}$, $6.9\times10^{12}$, $7\times10^{12}$, $8\times10^{12}$, $9\times10^{12}$, $1\times10^{13}$, $1.1\times10^{13}$, $1.2\times10^{13}$, $1.3\times10^{13}$, $1.4\times10^{13}$, $1.5\times10^{13}$, $1.6\times10^{13}$, $1.7\times10^{13}$, $1.8\times10^{13}$, $1.9\times10^{13}$, $2\times10^{13}$, $3\times10^{13}$, $4\times10^{13}$, $5\times10^{13}$, $6\times10^{13}$, $6.7\times10^{13}$, $7\times10^{13}$, $8\times10^{13}$, $9\times10^{13}$, $1\times10^{14}$, $2\times10^{14}$, $3\times10^{14}$, $4\times10^{14}$, $5\times10^{14}$, $6\times10^{14}$, $7\times10^{14}$, $8\times10^{14}$, $9\times10^{14}$, $1\times10^{15}$, $2\times10^{15}$, $3\times10^{15}$, $4\times10^{15}$, $5\times10^{15}$, $6\times10^{15}$, $7\times10^{15}$, $8\times10^{15}$, $9\times10^{15}$, or $1\times10^{16}$ VG/mL.

In certain embodiments, the desired siRNA duplex dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. As used herein, a "split dose" is the division of single unit dose or total daily dose into two or more doses, e.g., two or more administrations of the single unit dose. As used herein, a "single unit dose" is a dose of any modulatory polynucleotide therapeutic administered in one dose/at one time/single route/single point of contact, i.e., single administration event. As used herein, a "total daily dose" is an amount given or prescribed in a 24 hour period. It may be administered as a single unit dose. In one embodiment, the AAV particles comprising the modulatory polynucleotides of the present invention are administered to a subject in split doses. They may be formulated in buffer only or in a formulation described herein.

In one embodiment, the dose, concentration and/or volume of the composition described herein may be adjusted depending on the contribution of the caudate or putamen to cortical and subcortical distribution after administration. The administration may be intracerebroventricular, intraputamenal, intrathalamic, intraparenchymal, subpial, and/or intrathecal administration.

In one embodiment, the dose, concentration and/or volume of the composition described herein may be adjusted depending on the cortical and neuraxial distribution following administration by intracerebroventricular, intraputamenal, intrathalamic, intraparenchymal, subpial, and/or intrathecal delivery.

IV. Methods and Uses of the Compositions of the Invention

Huntington's Disease (HD)

Huntington's Disease (HD) is a monogenic fatal neurodegenerative disease characterized by progressive chorea, neuropsychiatric and cognitive dysfunction. Huntington's disease is known to be caused by an autosomal dominant triplet (CAG) repeat expansion in the huntingtin (HTT) gene, which encodes poly-glutamine at the N-terminus of the HTT protein. This repeat expansion results in a toxic gain of function of HTT and ultimately leads to striatal neurodegeneration which progresses to widespread brain atrophy. Medium spiny neurons of the striatum appear to be especially vulnerable in HD with up to 95% loss, whereas interneurons are largely spared.

Huntington's Disease has a profound impact on quality of life. Symptoms typically appear between the ages of 35-44 and life expectancy subsequent to onset is 10-25 years. In a small percentage of the HD population (~6%), disease onset occurs prior to the age of 21 with appearance of an akinetic-rigid syndrome. These cases tend to progress faster than those of the later onset variety and have been classified as juvenile or Westphal variant HD. It is estimated that approximately 35,000-70,000 patients are currently suffering from HD in the US and Europe. Currently, only symptomatic relief and supportive therapies are available for treatment of HD, with a cure yet to be identified. Ultimately, individuals with HD succumb to pneumonia, heart failure or other complications such as physical injury from falls.

While not wishing to be bound by theory, the function of the wild type HTT protein may serve as a scaffold to coordinate complexes of other proteins. HTT is a very large protein (67 exons, 3144 amino acids, ~350 kDa) that undergoes extensive post-translational modification and has numerous sites for interaction with other proteins, particularly at its N-terminus (coincidently the region that carries the repeats in HD). HTT localizes primarily to the cytoplasm but has been shown to shuttle into the nucleus where it may regulate gene transcription. It has also been suggested that HTT has a role in vesicular transport and regulating RNA trafficking.

As a non-limiting example, the HTT protein sequence is SEQ ID NO: 1424 (NCBI NP_002102.4) and the HTT nucleic acid sequence is SEQ ID NO: 1425 (NCBI NM_002111.7).

The mechanisms by which CAG-expanded HTT disrupts normal HTT function and results in neurotoxicity were initially thought to be a disease of haploinsufficiency, this theory was disproven when terminal deletion of the HTT gene in man did not lead to development of HD, suggesting that fully expressed HTT protein is not critical to survival. However, conditional knockout of HTT in mouse led to neurodegeneration, indicating that some amount of HTT is necessary for cell survival. Huntingtin protein is expressed in all cells, though its concentration is highest in the brain where large aggregates of abnormal HTT are found in neuronal nuclei. In the brains of HD patients, HTT aggregates into abnormal nuclear inclusions. It is now believed that it is this process of misfolding and aggregating along with the associated protein intermediates (i.e. the soluble species and toxic N-terminal fragments) that result in neurotoxicity. In fact, HD belongs to a family of nine additional human genetic disorders all of which are characterized by CAG-expanded genes and resultant polyglutamine (poly-Q) protein products with subsequent formation of intraneuronal aggregates. Interestingly, in all of these diseases the length of the expansion correlates with both age of onset and rate of disease progression, with longer expansions linked to greater severity of disease.

Hypotheses on the molecular mechanisms underlying the neurotoxicity of CAG-expanded HTT and its resultant aggregates have been wide ranging, but include, caspase activation, dysregulation of transcriptional pathways, increased production of reactive oxygen species, mitochondrial dysfunction, disrupted axonal transport and/or inhibition of protein degradation systems within the cell. CAG-expanded HTT may not only have a toxic gain of function, but also exert a dominant negative effect by interfering with the normal function of other cellular proteins and processes. HTT has also been implicated in non-cell autonomous neurotoxicity, whereby a cell hosting HTT spreads the HTT to other neurons nearby.

In one embodiment, a subject has fully penetrant HD where the HTT gene has 41 or more CAG repeats (e.g., 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90 or more than 90 CAG repeats).

In one embodiment, a subject has incomplete penetrance where the HTT gene has between 36 and 40 CAG repeats (e.g., 36, 37, 38, 39 and 40 CAG repeats).

Symptoms of HD may include features attributed to CNS degeneration such as, but are not limited to, chorea, dystonia, bradykinesia incoordination, irritability and depression, problem solving difficulties, reduction in the ability of a person to function in their normal day to day life, diminished speech, and difficulty swallowing, as well as features not attributed to CNS degeneration such as, but not limited to, weight loss, muscle wasting, metabolic dysfunction and endocrine disturbances.

Model systems for studying Huntington's Disease which may be used with the modulatory polynucleotides and AAV particles described herein include, but are not limited to, cell models (e.g., primary neurons and induced pluripotent stem cells), invertebrate models (e.g., *drosophila* or *Caenorhabditis elegans*), mouse models (e.g., YAC128 mouse model; R6/2 mouse model; BAC, YAC and knock-in mouse model), rat models (e.g., BAC) and large mammal models (e.g., pigs, sheep or monkeys).

Studies in animal models of HD have suggested that phenotypic reversal is feasible, for example, subsequent to gene shut off in regulated-expression models. In a mouse model allowing shut off of expression of a 94-polyglutamine repeat HTT protein, not only was the clinical syndrome reversed but also the intracellular aggregates were resolved. Further, animal models in which silencing of HTT was tested, demonstrated promising results with the therapy being both well tolerated and showing potential therapeutic benefit.

Such siRNA mediated HTT expression inhibition may be used for treating HD. According to the present invention, methods for treating and/or ameliorating HD in a patient comprises administering to the patient an effective amount of AAV particles comprising a nucleic acid sequence encoding the siRNA molecules of the present invention into cells. The administration of the AAV particles comprising such a nucleic acid sequence will encode the siRNA molecules which cause the inhibition/silence of HTT gene expression.

In one embodiment, the AAV particles described herein may be used to reduce the amount of HTT in a subject in need thereof and thus provides a therapeutic benefit as described herein.

In certain aspects, the symptoms of HD include behavioral difficulties and symptoms such as, but not limited to, apathy or lack of initiative, dysphoria, irritability, agitation or anxiety, poor self-care, poor judgment, inflexibility, disinhibition, depression, suicidal ideation euphoria, aggression, delusions, compulsions, hypersexuality, hallucinations, speech deterioration, slurred speech, difficulty swallowing, weight loss, cognitive dysfunction which impairs executive functions (e.g., organizing, planning, checking or adapting alternatives, and delays in the acquisition of new motor skills), unsteady gait and involuntary movements (chorea). In other aspects, the composition of the present invention is applied to one or both of the brain and the spinal cord. In one embodiment, the survival of the subject is prolonged by treating any of the symptoms of HD described herein.

Disclosed in the present invention are methods for treating Huntington's Disease (HD) associated with HTT protein in a subject in need of treatment. The method optionally comprises administering to the subject a therapeutically effective amount of a composition comprising at least AAV particles comprising a nucleic acid sequence encoding the siRNA molecules of the present invention. As a non-limiting example, the siRNA molecules can silence HTT gene expression, inhibit HTT protein production, and reduce one or more symptoms of HD in the subject such that HD is therapeutically treated.

Method of Treatment of Huntington's Disease

The present invention provides AAV particles comprising modulatory polynucleotides encoding siRNA molecules targeting the HTT gene, and methods for their design and manufacture. While not wishing to be bound by a single theory of operability, the invention provides modulatory polynucleotides, including siRNAs, that interfere with HTT expression, including HTT mutant and/or wild-type HTT gene expression. Particularly, the present invention employs viral genomes such as adeno-associated viral (AAV) viral genomes comprising modulatory polynucleotide sequences encoding the siRNA molecules of the present invention. The AAV vectors comprising the modulatory polynucleotides encoding the siRNA molecules of the present invention may increase the delivery of active agents into neurons of interest such as medium spiny neurons of the striatum and cortical neurons. The siRNA duplexes or encoded dsRNA targeting the HTT gene may be able to inhibit HTT gene expression (e.g., mRNA level) significantly inside cells; therefore, reducing HTT expression induced stress inside the cells such as aggregation of protein and formation of inclusions, increased free radicals, mitochondrial dysfunction and RNA metabolism.

Provided in the present invention are methods for introducing the AAV particles comprising a modulatory polynucleotide sequence encoding the siRNA molecules of the present invention into cells, the method comprising introducing into said cells any of the AAV particles in an amount sufficient for degradation of target HTT mRNA to occur, thereby activating target-specific RNAi in the cells. In some aspects, the cells may be stem cells, neurons such as medium spiny or cortical neurons, muscle cells and glial cells such as astrocytes.

In some embodiments, the present invention provides methods for treating or ameliorating Huntington's Disease (HD) by administering to a subject in need thereof a therapeutically effective amount of a plasmid or AAV vector described herein.

In some embodiments, the AAV particles comprising modulatory polynucleotides encoding the siRNA molecules of the present invention may be used to treat and/or ameliorate for HD.

In one embodiment, the AAV particles comprising modulatory polynucleotides encoding the siRNA molecules of the present invention may be used to reduce the cognitive and/or motor decline of a subject with HD, where the amount of decline is determined by a standard evaluation system such as, but not limited to, Unified Huntington's Disease Ratings Scale (UHDRS) and subscores, and cognitive testing.

In one embodiment, the AAV particles comprising modulatory polynucleotides encoding the siRNA molecules of the present invention may be used to reduce the decline of functional capacity and activities of daily living as measured by a standard evaluation system such as, but not limited to, the total functional capacity (TFC) scale.

In some embodiments, the present invention provides methods for treating, or ameliorating Huntington's Disease associated with HTT gene and/or HTT protein in a subject in need of treatment, the method comprising administering to the subject a pharmaceutically effective amount of AAV particles comprising modulatory polynucleotides encoding at least one siRNA duplex targeting the HTT gene, inhibiting HTT gene expression and protein production, and ameliorating symptoms of HD in the subject.

In one embodiment, the AAV vectors of the present invention may be used as a method of treating Huntington's disease in a subject in need of treatment. Any method known in the art for defining a subject in need of treatment may be used to identify said subject(s). A subject may have a clinical diagnosis of Huntington's disease, or may be pre-symptomatic. Any known method for diagnosing HD may be utilized, including, but not limited to, cognitive assessments and/or neurological or neuropsychiatric examinations, motor tests, sensory tests, psychiatric evaluations, brain imaging, family history and/or genetic testing.

In one embodiment, HD subject selection is determined with the use of the Prognostic Index for Huntington's Disease, or a derivative thereof (Long J D et al., *Movement Disorders*, 2017, 32(2), 256-263, the contents of which are herein incorporated by reference in their entirety). This prognostic index uses four components to predict probability of motor diagnosis, (1) total motor score (TMS) from the Unified Huntington's Disease Rating Scale (UHDRS), (2) Symbol Digit Modality Test (SDMT), (3) base-line age, and (4) cytosine-adenine-guanine (CAG) expansion.

In one embodiment, the prognostic index for Huntington's Disease is calculated with the following formula: $PI_{HD}=51 \times TMS+(-34) \times SDMT+7 \times Age \times (CAG-34)$, wherein larger values for $PI_{HD}$ indicate greater risk of diagnosis or onset of symptoms.

In another embodiment, the prognostic index for Huntington's Disease is calculated with the following normalized formula that gives standard deviation units to be interpreted in the context of 50% 10-year survival: $PIN_{HD}=(PI_{HD}-883)/1044$, wherein $PIN_{HD}<0$ indicates greater than 50% 10-year survival, and $PIN_{HD}>0$ suggests less than 50% 10-year survival.

In one embodiment, the prognostic index may be used to identify subjects whom will develop symptoms of HD within several years, but that do not yet have clinically diagnosable symptoms. Further, these asymptomatic patients may be selected for and receive treatment using the AAV vectors and compositions of the present invention during the asymptomatic period.

In one embodiment, the AAV particles may be administered to a subject who has undergone biomarker assessment. Potential biomarkers in blood for premanifest and early progression of HD include, but are not limited to, 8-OhdG oxidative stress marker, metabolic markers (e.g., creatine kinase, branched-chain amino acids, cholesterol metabolites (e.g., 24-OH cholesterol), immune and inflammatory proteins (e.g., clusterin, complement components, interleukins 6 and 8), gene expression changes (e.g., transcriptomic markers), endocrine markers (e.g., cortisol, ghrelin and leptin), BDNF, adenosine 2A receptors. Potential biomarkers for brain imaging for premanifest and early progression of HD include, but are not limited to, striatal volume, subcortical white-matter volume, cortical thickness, whole brain and ventricular volumes, functional imaging (e.g., functional MRI), PET (e.g., with fluorodeoxyglucose), and magnetic resonance spectroscopy (e.g., lactate). Potential biomarkers for quantitative clinical tools for premanifest and early progression of HD include, but are not limited to, quantitative motor assessments, motor physiological assessments (e.g., transcranial magnetic stimulation), and quantitative eye movement measurements. Non-limiting examples of quantitative clinical biomarker assessments include tongue force variability, metronome-guided tapping, grip force, oculomotor assessments and cognitive tests. Non-limiting examples of multicenter observational studies include PREDICT-HD and TRACK-HD. A subject may have symptoms of HD, diagnosed with HD or may be asymptomatic for HD.

In one embodiment, the AAV particles may be administered to a subject who has undergone biomarker assessment using neuroimaging. A subject may have symptoms of HD, diagnosed with HD or may be asymptomatic for HD.

In one embodiment, the AAV particles may be administered to a subject who is asymptomatic for HD. A subject may be asymptomatic but may have undergone predictive genetic testing or biomarker assessment to determine if they are at risk for HD and/or a subject may have a family member (e.g., mother, father, brother, sister, aunt, uncle, grandparent) who has been diagnosed with HD.

In one embodiment, the AAV particles may be administered to a subject who is in the early stages of HD. In the early stage a subject has subtle changes in coordination, some involuntary movements (chorea), changes in mood such as irritability and depression, problem solving difficulties, reduction in the ability of a person to function in their normal day to day life.

In one embodiment, the AAV particles may be administered to a subject who is in the middle stages of HD. In the middle stage a subject has an increase in the movement disorder, diminished speech, difficulty swallowing, and ordinary activities will become harder to do. At this stage a subject may have occupational and physical therapists to help maintain control of voluntary movements and a subject may have a speech language pathologist.

In one embodiment, the AAV particles may be administered to a subject who is in the late stages of HD. In the late stage, a subject with HD is almost completely or completely dependent on others for care as the subject can no longer walk and is unable to speak. A subject can generally still comprehend language and is aware of family and friends but choking is a major concern.

In one embodiment, the AAV particles may be used to treat a subject who has the juvenile form of HD which is the onset of HD before the age of 20 years and as early as 2 years.

In one embodiment, the AAV particles may be used to treat a subject with HD who has fully penetrant HD where the HTT gene has 41 or more CAG repeats (e.g., 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90 or more than 90 CAG repeats).

In one embodiment, the AAV particles may be used to treat a subject with HD who has incomplete penetrance where the HTT gene has between 36 and 40 CAG repeats (e.g., 36, 37, 38, 39 and 40 CAG repeats).

In some embodiments, the composition comprising the AAV particles comprising modulatory polynucleotides encoding the siRNA molecules of the present invention is administered to the central nervous system of the subject. In other embodiments, the composition comprising the AAV particles comprising modulatory polynucleotides encoding the siRNA molecules of the present invention is administered to a tissue of a subject (e.g., brain of the subject).

In one embodiment, the AAV particles comprising modulatory polynucleotides encoding the siRNA molecules of the present invention may be delivered into specific types of targeted cells, including, but not limited to, neurons including medium spiny or cortical neurons; glial cells including oligodendrocytes, astrocytes and microglia; and/or other cells surrounding neurons such as T cells.

In one embodiment, the AAV particles comprising modulatory polynucleotides encoding the siRNA molecules of the present invention may be delivered to neurons in the striatum and/or neurons of the cortex.

In some embodiments, the composition of the present invention for treating HD is administered to the subject in need intravenously, intramuscularly, subcutaneously, intraperitoneally, intraparenchymally, subpially, intrathecally and/or intraventricularly, allowing the siRNA molecules or vectors comprising the siRNA molecules to pass through one or both the blood-brain barrier and the blood spinal cord barrier, or directly access the brain and/or spinal cord. In some aspects, the method includes administering (e.g., intraparenchymal administration, subpial administration, intraventricular administration and/or intrathecal administration) directly to the central nervous system (CNS) of a subject (using, e.g., an infusion pump and/or a delivery scaffold) a therapeutically effective amount of a composition comprising AAV particles encoding the nucleic acid sequence for the siRNA molecules of the present invention. The vectors may be used to silence or suppress HTT gene expression, and/or reducing one or more symptoms of HD in the subject such that HD is therapeutically treated.

In some embodiments, the siRNA molecules or the AAV vectors comprising such siRNA molecules may be introduced directly into the central nervous system of the subject, for example, by infusion to the white matter a subject. While not wishing to be bound by theory, distribution via direct white matter infusion may be independent of axonal transport mechanisms which may be impaired in subjects with Huntington's Disease which means white matter infusion may allow for more transport of the AAV vectors.

In one embodiment, the composition comprising the AAV particles comprising modulatory polynucleotides encoding the siRNA molecules of the present invention is administered to the central nervous system of the subject via intraparenchymal injection.

In one embodiment, the AAV particle composition comprising modulatory polynucleotides encoding the siRNA molecules of the present invention is administered to the central nervous system of the subject via intraparenchymal injection and intrathecal injection.

In one embodiment, the AAV particle composition comprising modulatory polynucleotides encoding the siRNA molecules of the present invention is administered to the central nervous system of the subject via intraparenchymal injection and intracerebroventricular injection.

In some embodiments, the composition of the present invention for treating HD is administered to the subject in need by intraparenchymal administration.

In some embodiments, the AAV particle composition comprising modulatory polynucleotides encoding the siRNA molecules of the present invention may be introduced directly into the central nervous system of the subject, for example, by infusion into the putamen.

In some embodiments, the AAV particle composition comprising modulatory polynucleotides encoding the siRNA molecules of the present invention may be introduced directly into the central nervous system of the subject, for example, by infusion into the thalamus of a subject. While not wishing to be bound by theory, the thalamus is an area of the brain which is relatively spared in subjects with Huntington's Disease which means it may allow for more widespread cortical transduction via axonal transport of the AAV vectors.

In some embodiments, the AAV particle composition comprising modulatory polynucleotides encoding the siRNA molecules of the present invention may be introduced indirectly into the central nervous system of the subject, for example, by intravenous administration.

Modulate HTT Expression

In one embodiment, administration of the AAV particles to a subject will reduce the expression of HTT in a subject and the reduction of expression of the HTT will reduce the effects of HD in a subject.

In one embodiment, the encoded dsRNA once expressed and contacts a cell expressing HTT protein, inhibits the expression of HTT protein by at least 10%, at least 20%, at least 25%, at least 30%, at least 35% or at least 40% or more, such as when assayed by a method as described herein.

In one embodiment, administration of the AAV particles comprising a modulatory polynucleotide sequence encoding a siRNA of the invention, to a subject may lower HTT (e.g., mutant HTT, wild-type HTT and/or mutant and wild-type HTT) in a subject. In one embodiment, administration of the AAV particles to a subject may lower wild-type HTT in a subject. In yet another embodiment, administration of the AAV particles to a subject may lower both mutant HTT and wild-type HTT in a subject. The mutant and/or wild-type HTT may be lowered by about 20%, 30%, 40%, 50%, 60%, 70%, 80%, 85%, 90%, 95% and 100%, or at least 20-30%, 20-40%, 20-50%, 20-60%, 20-70%, 20-80%, 20-90%, 20-950%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100% in a subject such as, but not limited to, the CNS, a region of the CNS, or a specific cell of the CNS of a subject. The mutant HTT may be lowered by about 20%, 30%, 40%, 50%, 60%, 70%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100% in a subject such as, but not limited to, the CNS, a region of the CNS, or a specific cell of the CNS of a subject. The wild-type HTT may be lowered by about 20%, 30%, 40%, 50%, 60%, 70%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100% in a subject such as, but not limited to, the CNS, a region of the CNS, or a specific cell of the CNS of a subject. The mutant and wild-type HTT may be lowered by about 20%, 30%, 40%, 50%, 60%, 70%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100% in a subject such as, but not limited to, the CNS, a region of the CNS, or a specific cell of the CNS of a subject. As a non-limiting example, the AAV particles may lower the expression of HTT by at least 50% in the medium spiny neurons. As a non-limiting example, the vectors, e.g., AAV vectors may lower the expression of HTT by at least 40% in the medium spiny neurons. As a non-limiting example, the AAV particles may lower the expression of HTT by at least 40% in the medium spiny neurons of the putamen. As a non-limiting example, AAV particles may lower the expression of HTT by at least 30% in the medium spiny neurons of the putamen. As yet another non-limiting example, the AAV particles may lower the expression of HTT in the putamen and cortex by at least 40%. As yet another non-limiting example, the AAV particles may lower the expression of HTT in the putamen and cortex by at least 30%. As yet another non-limiting example, the AAV particles may lower the expression of HTT in the putamen by at least 30%. As yet another non-limiting example, the AAV particles may lower the expression of HTT in the putamen by at least 30% and cortex by at least 15%.

In one embodiment, the AAV particles may be used to reduce the expression of HTT protein by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 55-60%, 55-70%, 55-80%, 55-90%, 55-95%, 55-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%. As a non-limiting example, the expression of HTT protein expression may be reduced by 50-90%. As a non-limiting example, the expression of HTT protein expression may be reduced by 30-70%.

In one embodiment, the siRNA duplexes or encoded dsRNA may be used to reduce the expression of HTT mRNA by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-600%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 55-60%, 55-70%, 55-80%, 55-90%, 55-95%, 55-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%. As a non-limiting example, the expression of HTT mRNA may be reduced 50-90%.

In one embodiment, the AAV particles may be used to decrease HTT protein in a subject. The decrease may independently be 5%, 10%, 15%, 20%, 25%, 30%, 35%, 40%, 45%, 50%, 55%, 60%, 65%, 70%, 75%, 80%, 85%, 90%, 95%, or more than 95%, 5-15%, 5-20%, 5-25%, 5-30%, 5-35%, 5-40%, 5-45%, 5-50%, 5-55%, 5-60%, 5-65%, 5-70%, 5-75%, 5-80%, 5-85%, 5-90%, 5-95%, 10-20%, 10-25%, 10-30%, 10-35%, 10-40%, 10-45%, 10-50%, 10-55%, 10-60%, 10-65%, 10-70%, 10-75%, 10-80%, 10-85%, 10-90%, 10-95%, 15-25%, 15-30%, 15-35%, 15-40%, 15-45%, 15-50%, 15-55%, 15-60%, 15-65%, 15-70%, 15-75%, 15-80%, 15-85%, 15-90%, 15-95%, 20-30%, 20-35%, 20-40%, 2045%, 20-50%, 20-55%, 20-60%, 20-65%, 20-70%, 20-75%, 20-80%, 20-85%, 20-90%, 20-95%, 25-35%, 25-40%, 25-45%, 25-50%, 25-55%, 25-60%, 25-65%, 25-70%, 25-75%, 25-80%, 25-85%, 25-90%, 25-95%, 30-40%, 30-45%, 30-50%, 30-55%, 30-60%, 30-65%, 30-70%, 30-75%, 30-80%, 30-85%, 30-90%, 30-95%, 35-45%, 35-50%, 35-55%, 35-60%, 35-65%, 35-70%, 35-75%, 35-80%, 35-85%, 35-90%, 35-95%, 40-50%, 40-55%, 40-60%, 40-65%, 40-70%, 40-75%, 40-80%, 40-85%, 40-90%, 40-95%, 45-50%, 45-60%, 45-65%, 45-70%, 45-75%, 45-80%, 45-85%, 45-90%, 45-95%, 50-60%, 50-65%, 50-70%, 50-75%, 50-80%, 50-85%, 50-90%, 50-95%, 55-65%, 55-70%, 55-75%, 55-80%, 55-85%, 55-90%, 55-95%, 60-70%, 60-75%, 60-80%, 60-85%, 60-90%, 60-95%, 65-75%, 65-80%, 65-85%, 65-90%, 65-95%, 70-80%, 70-85%, 70-90%, 70-95%, 75-85%, 75-90%, 75-95%, 80-90%, 80-95%, or 90-95%. As a non-limiting example, a subject may have a 50% decrease of HTT protein. As a non-limiting example, a subject may have a decrease of 70% of HTT protein and a decrease of 10% of wild type HTT protein. As a non-limiting example, the decrease of HTT in the medium spiny neurons of the putamen may be about 40%. As a non-limiting example, the decrease of HTT in the putamen and cortex may be about 40%. As a non-limiting example, the decrease of HTT in the medium spiny neurons of the putamen may be between 40%-70%. As a non-limiting example, the decrease of HTT in the putamen and cortex may be between 40%-70%.

In one embodiment, the AAV particles may be used to decrease wild type HTT protein in a subject. The decrease may independently be 5%, 10%, 15%, 20%, 25%, 30%, 35%, 40%, 45%, 50%, 55%, 60%, 65%, 70%, 75%, 80%, 85%, 90%, 95%, or more than 95%, 5-15%, 5-20%, 5-25%, 5-30%, 5-35%, 5-40%, 5-45%, 5-50, 5-55%, 5-60%, 5-65%, 5-70%, 5-75%, 5-80%, 5-85%, 5-90%, 5-95%, 10-20%, 10-25%, 10-30%, 10-35%, 10-40%, 10-45%, 10-50%, 10-55%, 10-60%, 10-65%, 10-70%, 10-75%, 10-80%, 10-85%, 10-90%, 10-95%, 15-25%, 15-30%, 15-35%, 15-40%, 15-45%, 15-50%, 15-55%, 15-60%, 15-65%, 15-70%, 15-75%, 15-80%, 15-85%, 15-90%, 15-95%, 20-30%, 20-35%, 20-40%, 2045%, 20-50%, 20-55%, 20-60%, 20-65%, 20-70%, 20-75%, 20-80%, 20-85%, 20-90%, 20-95%, 25-35%, 25-40%, 25-45%, 25-50%, 25-55%, 25-60%, 25-65%, 25-70%, 25-75%, 25-80%, 25-85%, 25-90%, 25-95%, 30-40%, 30-45%, 30-50%, 30-55%, 30-60%, 30-65%, 30-70%, 30-75%, 30-80%, 30-85%, 30-90%, 30-95%, 35-45%, 35-50%, 35-55%, 35-60%, 35-65%, 35-70%, 35-75%, 35-80%, 35-85%, 35-90%, 35-95%, 40-50%, 40-55%, 40-60%, 40-65%, 40-70%, 40-75%, 40-80%, 40-85%, 40-90%, 40-95%, 45-55%, 45-60%, 45-65%, 45-70%, 45-75%, 45-80%, 45-85%, 45-90%, 45-95%, 50-60%, 50-65%, 50-70%, 50-75%, 50-80%, 50-85%, 50-90%, 50-95%, 55-65%, 55-70%, 55-75%, 55-80%, 55-85%, 55-90%, 55-95%, 60-70%, 60-75%, 60-80%, 60-85%, 60-90%, 60-95%, 65-75%, 65-80%, 65-85%, 65-90%, 65-95%, 70-80%, 70-85%, 70-90%, 70-95%, 75-85%, 75-90%, 75-95%, 80-90%, 80-95%, or 90-95%. As a non-limiting example, a subject may have a 50% decrease of wild type HTT protein. As a non-limiting example, the decrease of wild type HTT in the medium spiny neurons of the putamen may be about 40%. As a non-limiting example, the decrease of wild type HTT in the putamen and cortex may be about 40%. As a non-limiting example, the decrease of wild type HTT in the medium spiny neurons of the putamen may be between 40%-70%. As a non-limiting example, the decrease of wild type HTT in the putamen and cortex may be between 40/6-70%.

In one embodiment, the AAV particles may be used to decrease mutant HTT protein in a subject. The decrease may independently be 5%, 10%, 15%, 20%, 25%, 30%, 35%, 40%, 45%, 50%, 55%, 60%, 65%, 70%, 75%, 80%, 85%, 90%, 95%, or more than 95%, 5-15%, 5-20%, 5-25%, 5-30%, 5-35%, 5-40%, 5-45%, 5-50%, 5-55%, 5-60%, 5-65%, 5-70%, 5-75%, 5-80%, 5-85%, 5-90%, 5-95%, 10-20%, 10-25%, 10-30%, 10-35%, 1040%, 1045%, 10-50%, 10-55%, 10-60%, 10-65%, 10-70%, 10-75%, 10-80%, 10-85%, 10-90%, 10-95%, 15-25%, 15-30%, 15-35%, 1540%, 1545%, 15-50%, 15-55%, 15-60%, 15-65%, 15-70%, 15-75%, 15-80%, 15-85%, 15-90%, 15-95%, 20-30%, 20-35%, 20-40%, 20-45%, 20-50%, 20-55%, 20-60%, 20-65%, 20-70%, 20-75%, 20-80%, 20-85%, 20-90%, 20-95%, 25-35%, 25-40%, 25-45%, 25-50%, 25-55%, 25-60%, 25-65%, 25-70%, 25-75%, 25-80%, 25-85%, 25-90%, 25-95%, 30-40%, 30-45%, 30-50%, 30-55%, 30-60%, 30-65%, 30-70%, 30-75%, 30-80%, 30-85%, 30-90%, 30-95%, 35-45%, 35-50%, 35-55%, 35-60%, 35-65%, 35-70%, 35-75%, 35-80%, 35-85%, 35-90%, 35-95%, 40-50%, 40-55%, 40-60%, 40-65%, 40-70%, 40-75%, 40-80%, 40-85%, 40-90%, 40-95%, 45-55%, 45-60%, 45-65%, 45-70%, 45-75%, 45-80%, 45-85%, 45-90%, 45-95%, 50-60%, 50-65%, 50-70%, 50-75%, 50-80%, 50-85%, 50-90%, 50-95%, 55-65%, 55-70%, 55-75%, 55-80%, 55-85%, 55-90%, 55-95%, 60-70%, 60-75%, 60-80%, 60-85%, 60-90%, 60-95%, 65-75%, 65-80%, 65-85%, 65-90%, 65-95%, 70-80%, 70-85%, 70-90%, 70-95%, 75-85%, 75-90%, 75-95%, 80-90%, 80-95%, or 90-95%. As a non-limiting example, a subject may have a 50% decrease of mutant HTT protein. As a non-limiting example, the decrease of mutant HTT in the medium spiny neurons of the putamen may be about 40%. As a non-limiting example, the decrease of mutant HTT in the putamen and cortex may be about 40%. As a non-limiting example, the decrease of mutant HTT in the medium spiny neurons of the putamen may be between 40%-70%. As a non-limiting example, the decrease of mutant HTT in the putamen and cortex may be between 40%-70%.

In some embodiments, the present invention provides methods for inhibiting/silencing HTT gene expression in a cell. Accordingly, the siRNA duplexes or encoded dsRNA can be used to substantially inhibit HTT gene expression in a cell, in particular in a neuron. In some aspects, the inhibition of HTT gene expression refers to an inhibition by at least about 20%, such as by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 55-60%, 55-70%, 55-80%, 55-90%, 55-95%, 55-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%. Accordingly, the protein product of the targeted gene may be inhibited by at least about 20%, preferably by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%.

In some embodiments, the present invention provides methods for inhibiting/silencing HTT gene expression in a cell, in particular in a medium spiny neuron. In some aspects, the inhibition of HTT gene expression refers to an inhibition by at least about 20%, such as by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 55-60%, 55-70%, 55-80%, 55-90%, 55-95%, 55-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%. Accordingly, the protein product of the targeted gene may be inhibited by at least about 20%, preferably by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 55-60%, 55-70%, 55-80%, 55-90%, 55-95%, 55-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%.

In some embodiments, the present invention provides methods for inhibiting/silencing HTT gene expression in a cell, in particular in an astrocyte. In some aspects, the inhibition of HTT gene expression refers to an inhibition by at least about 20%, such as by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 55-60%, 55-70%, 55-80%, 55-90%, 55-95%, 55-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%. Accordingly, the protein product of the targeted gene may be inhibited by at least about 20%, preferably by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 650%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 55-60%, 55-70%, 55-80%, 55-90%, 55-95%, 55-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%.

In one embodiment, the siRNA duplexes or encoded dsRNA may be used to reduce the expression of HTT protein and/or mRNA in at least one region of the CNS such as, but not limited to the midbrain. The expression of HTT protein and/or mRNA is reduced by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 55-60%, 55-70%, 55-80%, 55-90%, 55-95%, 55-100%, 60-70%, 60-80%, 60-90%, 60-95%, 60-100%, 70-80%, 70-90%, 70-95%, 70-100%, 80-90%, 80-95%, 80-100%, 90-95%, 90-100%, or 95-100% in at least one region of the CNS. As a non-limiting example, the expression of HTT protein and mRNA in the striatum and/or cortex is reduced by 50-90%. As a non-limiting example, the expression of HTT protein and mRNA in the striatum is reduced by 40-50%. As a non-limiting example, the expression of HTT protein and mRNA in the cortex is reduced by 40-50%. As a non-limiting example, the expression of HTT protein and mRNA in the cortex is reduced by 30-70%. As a non-limiting example, the expression of HTT protein and mRNA in the striatum and/or cortex is reduced by 40-70%. As a non-limiting example, the expression of HTT protein and mRNA in the striatum and/or cortex is reduced by 40-50%. As a non-limiting example, the expression of HTT protein and mRNA in the striatum and/or cortex is reduced by 50-70%. As a non-limiting example, the expression of HTT protein and mRNA in the striatum and/or cortex is reduced by 50-60%. As a non-limiting example, the expression of HTT protein and mRNA in the striatum and/or cortex is reduced by 50%. As a non-limiting example, the expression of HTT protein and mRNA in the striatum and/or cortex is reduced by 51%. As a non-limiting example, the expression of HTT protein and mRNA in the striatum and/or cortex is reduced by 52%. As a non-limiting example, the expression of HTT protein and mRNA in the striatum and/or cortex is reduced by 53%. As a non-limiting example, the expression of HTT protein and mRNA in the striatum and/or cortex is reduced by 54%. As a non-limiting example, the expression of HTT protein and mRNA in the striatum and/or cortex is reduced by 55%. As a non-limiting example, the expression of HTT protein and mRNA in the striatum and/or cortex is reduced by 56%. As a non-limiting example, the expression of HTT protein and mRNA in the striatum and/or cortex is reduced by 57%. As a non-limiting example, the expression of HTT protein and mRNA in the striatum and/or cortex is reduced by 58%. As a non-limiting example, the expression of HTT protein and mRNA in the striatum and/or cortex is reduced by 59%. As a non-limiting example, the expression of HTT protein and mRNA in the striatum and/or cortex is reduced by 60%.

In one embodiment, the siRNA duplexes or encoded dsRNA may be used to reduce the expression of HTT protein and/or mRNA in at least one region of the CNS such as, but not limited to the forebrain. The expression of HTT protein and/or mRNA is reduced by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 55-60%, 55-70%, 55-80%, 55-90%, 55-95%, 55-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100% in at least one region of the CNS. As a non-limiting example, the expression of HTT protein and mRNA in the putamen is reduced by 50-90%. As a non-limiting example, the expression of HTT protein and mRNA in the striatum is reduced by 40-50%. As a non-limiting example, the expression of HTT protein and mRNA in the cortex is reduced by 40-50%. As a non-limiting example, the expression of HTT protein and mRNA in the cortex is reduced by 30-70%. As a non-limiting example, the expression of HTT protein and mRNA in the striatum and/or cortex is reduced by 40-70%. As a non-limiting example, the expression of HTT protein and mRNA in the striatum and/or cortex is reduced by 40-50%. As a non-limiting example, the expression of HTT protein and mRNA in the striatum and/or cortex is reduced by 50-70%. As a non-limiting example, the expression of HTT protein and mRNA in the striatum and/or cortex is reduced by 50-60%. As a non-limiting example, the expression of HTT protein and mRNA in the striatum and/or cortex is reduced by 50%. As a non-limiting example, the expression of HTT protein and mRNA in the striatum and/or cortex is reduced by 51%. As a non-limiting example, the expression of HTT protein and mRNA in the striatum and/or cortex is reduced by 52%. As a non-limiting example, the expression of HTT protein and mRNA in the striatum and/or cortex is reduced by 53%. As a non-limiting example, the expression of HTT protein and mRNA in the striatum and/or cortex is reduced by 54%. As a non-limiting example, the expression of HTT protein and mRNA in the striatum and/or cortex is reduced by 55%. As a non-limiting example, the expression of HTT protein and mRNA in the striatum and/or cortex is reduced by 56%. As a non-limiting example, the expression of HTT protein and mRNA in the striatum and/or cortex is reduced by 57%. As a non-limiting example, the expression of HTT protein and mRNA in the striatum and/or cortex is reduced by 58%. As a non-limiting example, the expression of HTT protein and mRNA in the striatum and/or cortex is reduced by 59%. As a non-limiting example, the expression of HTT protein and mRNA in the striatum and/or cortex is reduced by 60%.

In one embodiment, the siRNA duplexes or encoded dsRNA may be used to reduce the expression of HTT protein and/or mRNA in the striatum. The expression of HTT protein and/or mRNA is reduced by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%. As a non-limiting example, the expression of HTT protein and mRNA in the striatum is reduced by 40-50%. As a non-limiting example, the expression of HTT protein and mRNA in the striatum is reduced by 30-70%. As a non-limiting example, the expression of HTT protein and mRNA in the striatum is reduced by at least 30%. As a non-limiting example, the expression of HTT protein and mRNA in the striatum is reduced by 40-70%. As a non-limiting example, the expression of HTT protein and mRNA in the striatum is reduced by 40-50%. As a non-limiting example, the expression of HTT protein and mRNA in the striatum is reduced by 50-70%. As a non-limiting example, the expression of HTT protein and mRNA in the striatum is reduced by 50-60%. As a non-limiting example, the expression of HTT protein and mRNA in the striatum is reduced by 50%. As a non-limiting example, the expression of HTT protein and mRNA in the striatum is reduced by 51%. As a non-limiting example, the expression of HTT protein and mRNA in the striatum is reduced by 52%. As a non-limiting example, the expression of HTT protein and mRNA in the striatum is reduced by 53%. As a non-limiting example, the expression of HTT protein and mRNA in the striatum is reduced by 54%. As a non-limiting example, the expression of HTT protein and mRNA in the striatum is reduced by 55%. As a non-limiting example, the expression of HTT protein and mRNA in the striatum is reduced by 56%. As a non-limiting example, the expression of HTT protein and mRNA in the striatum is reduced by 57%. As a non-limiting example, the expression of HTT protein and mRNA in the striatum is reduced by 58%. As a non-limiting example, the expression of HTT protein and mRNA in the striatum is reduced by 59%. As a non-limiting example, the expression of HTT protein and mRNA in the striatum is reduced by 60%.

In some embodiments, the AAV particles comprising modulatory polynucleotides encoding the siRNA molecules of the present invention may be used to suppress HTT protein in neurons and/or astrocytes of the striatum and/or the cortex. As a non-limiting example, the suppression of HTT protein is in medium spiny neurons of the striatum and/or neurons of the cortex.

In some embodiments, the AAV particles comprising modulatory polynucleotides encoding the siRNA molecules of the present invention may be used to suppress HTT protein in neurons and/or astrocytes of the striatum and/or the cortex and reduce associated neuronal toxicity. The suppression of HTT protein in the neurons and/or astrocytes of the striatum and/or the cortex may be, independently, suppressed by 5%, 10%, 15%, 20%, 25%, 30%, 35%, 40%, 45%, 50%, 55%, 60%, 65%, 70%, 75%, 80%, 85%, 90%, 95%, or more than 95%, 5-15%, 5-20%, 5-25%, 5-30%, 5-35%, 5-40%, 5-45%, 5-50%, 5-55%, 5-60%, 5-65%, 5-70%, 5-75%, 5-80%, 5-85%, 5-90%, 5-95%, 10-20%, 10-25%, 10-30%, 10-35%, 10-40%, 10-45%, 10-50%, 10-55%, 10-60%, 10-65%, 10-70%, 10-75%, 10-80%, 10-85%, 10-90%, 10-95%, 15-25%, 15-30%, 15-35%, 15-40%, 15-45%, 15-50%, 15-55%, 15-60%, 15-65%, 15-70%, 15-75%, 15-80%, 15-85%, 15-90%, 15-95%, 20-30%, 20-35%, 20-40%, 20-45%, 20-50%, 20-55%, 20-60%, 20-65%, 20-70%, 20-75%, 20-80%, 20-85%, 20-90%, 20-95%, 25-35%, 25-40%, 25-45%, 25-50%, 25-55%, 25-60%, 25-65%, 25-70%, 25-75%, 25-80%, 25-85%, 25-90%, 25-95%, 30-40%, 30-45%, 30-50%, 30-55%, 30-60%, 30-65%, 30-70%, 30-75%, 30-80%, 30-85%, 30-90%, 30-95%, 35-45%, 35-50%, 35-55%, 35-60%, 35-65%, 35-70%, 35-75%, 35-80%, 35-85%, 35-90%, 35-95%, 40-50%, 40-55%, 40-60%, 40-65%, 40-70%, 40-75%, 40-80%, 40-85%, 40-90%, 40-95%, 45-55%, 45-60%, 45-65%, 45-70%, 45-75%, 45-80%, 45-85%, 45-90%, 45-95%, 50-60%, 50-65%, 50-70%, 50-75%, 50-80%, 50-85%, 50-90%, 50-95%, 55-65%, 55-70%, 55-75%, 55-80%, 55-85%, 55-90%, 55-95%, 60-70%, 60-75%, 60-80%, 60-85%, 60-90%, 60-95%, 65-75%, 65-80%, 65-85%, 65-90%, 65-95%, 70-80%, 70-85%, 70-90%, 70-95%, 75-85%, 75-90%, 75-95%, 80-90%, 80-95%, or 90-95%. The reduction of associated neuronal toxicity may be 5%, 10%, 15%, 20%, 25%, 30%, 35%, 40%, 45%, 50%, 55%, 60%, 65%, 70%, 75%, 80%, 85%, 90%, 95%, or more than 95%, 5-15%, 5-20%, 5-25%, 5-30%, 5-35%, 5-40%, 5-45%, 5-50%, 5-55%, 5-60%, 5-65%, 5-70%, 5-75%, 5-80%, 5-85%, 5-90%, 5-95%, 10-20%, 10-25%, 10-30%, 10-35%, 10-40%, 10-45%, 10-50%, 10-55%, 10-60%, 10-65%, 10-70%, 10-75%, 10-80%, 10-85%, 10-90%, 10-95%, 15-25%, 15-30%, 15-35%, 15-40%, 15-45%, 15-50%, 15-55%, 15-60%, 15-65%, 15-70%, 15-75%, 15-80%, 15-85%, 15-90%, 15-95%, 20-30%, 20-35%, 20-40%, 20-45%, 20-50%, 20-55%, 20-60%, 20-65%, 20-70%, 20-75%, 20-80%, 20-85%, 20-90%, 20-95%, 25-35%, 25-40%, 25-45%, 25-50%, 25-55%, 25-60%, 25-65%, 25-70%, 25-75%, 25-80%, 25-85%, 25-900%, 25-95%, 30-40%, 30-45%, 30-50%, 30-55%, 30-60%, 30-65%, 30-70%, 30-75%, 30-80%, 30-85%, 30-90%, 30-95%, 35-45%, 35-50%, 35-55%, 35-60%, 35-65%, 35-70%, 35-75%, 35-80%, 35-85%, 35-90%, 35-95%, 40-50%, 40-55%, 40-60%, 40-65%, 40-70%, 40-75%, 40-80%, 40-85%, 40-90%, 40-95%, 45-55%, 45-60%, 45-65%, 45-70%, 45-75%, 45-80%, 45-85%, 45-90%, 45-95%, 50-60%, 50-65%, 50-70%, 50-75%, 50-80%, 50-85%, 50-90%, 50-95%, 55-65%, 55-70%, 55-75%, 55-80%, 55-85%, 55-90%, 55-95%, 60-70%, 60-75%, 60-80%, 60-85%, 60-90%, 60-95%, 65-75%, 65-80%, 65-85%, 65-90%, 65-95%, 70-80%, 70-85%, 70-90%, 70-95%, 75-85%, 75-90%, 75-95%, 80-90%, 80-95%, or 90-95%.

In one embodiment, the siRNA duplexes or encoded dsRNA may be used to reduce the expression of HTT protein and/or mRNA in the cortex. The expression of HTT protein and/or mRNA is reduced by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%. As a non-limiting example, the expression of HTT protein and mRNA in the cortex is reduced by 40-50%. As a non-limiting example, the expression of HTT protein and mRNA in the cortex is reduced by 30-70%. As a non-limiting example, the expression of HTT protein and mRNA in the cortex is reduced by at least 30%. As a non-limiting example, the expression of HTT protein and mRNA in the cortex is reduced by 40-70%. As a non-limiting example, the expression of HTT protein and mRNA in the cortex is reduced by 40-50%. As a non-limiting example, the expression of HTT protein and mRNA in the cortex is reduced by 50-70%. As a non-limiting example, the expression of HTT protein and mRNA in the cortex is reduced by 50-60%. As a non-limiting example, the expression of HTT protein and mRNA in the cortex is reduced by 50%. As a non-limiting example, the expression of HTT protein and mRNA in the cortex is reduced by 51%. As a non-limiting example, the expression of HTT protein and mRNA in the cortex is reduced by 52%. As a non-limiting example, the expression of HTT protein and mRNA in the cortex is reduced by 53%. As a non-limiting example, the expression of HTT protein and mRNA in the cortex is reduced by 54%. As a non-limiting example, the expression of HTT protein and mRNA in the cortex is reduced by 55%. As a non-limiting example, the expression of HTT protein and mRNA in the cortex is reduced by 56%. As a non-limiting example, the expression of HTT protein and mRNA in the cortex is reduced by 57%. As a non-limiting example, the expression of HTT protein and mRNA in the cortex is reduced by 58%. As a non-limiting example, the expression of HTT protein and mRNA in the cortex is reduced by 59%. As a non-limiting example, the expression of HTT protein and mRNA in the cortex is reduced by 60%.

In one embodiment, the siRNA duplexes or encoded dsRNA may be used to reduce the expression of HTT protein and/or mRNA in the motor cortex. The expression of HTT protein and/or mRNA is reduced by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-700%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%. As a non-limiting example, the expression of HTT protein and mRNA in the motor cortex is reduced by 40-50%. As a non-limiting example, the expression of HTT protein and mRNA in the motor cortex is reduced by 30-70%. As a non-limiting example, the expression of HTT protein and mRNA in the motor cortex is reduced by at least 30%. As a non-limiting example, the expression of HTT protein and mRNA in the motor cortex is reduced by 40-70%. As a non-limiting example, the expression of HTT protein and mRNA in the motor cortex is reduced by 40-50%. As a non-limiting example, the expression of HTT protein and mRNA in the motor cortex is reduced by 50-70%. As a non-limiting example, the expression of HTT protein and mRNA in the motor cortex is reduced by 50-60%. As a non-limiting example, the expression of HTT protein and mRNA in the motor cortex is reduced by 50%. As a non-limiting example, the expression of HTT protein and mRNA in the motor cortex is reduced by 51%. As a non-limiting example, the expression of HTT protein and mRNA in the motor cortex is reduced by 52%. As a non-limiting example, the expression of HTT protein and mRNA in the motor cortex is reduced by 53%. As a non-limiting example, the expression of HTT protein and mRNA in the motor cortex is reduced by 54%. As a non-limiting example, the expression of HTT protein and mRNA in the motor cortex is reduced by 55%. As a non-limiting example, the expression of HTT protein and mRNA in the motor cortex is reduced by 56%. As a non-limiting example, the expression of HTT protein and mRNA in the motor cortex is reduced by 57%. As a non-limiting example, the expression of HTT protein and mRNA in the motor cortex is reduced by 58%. As a non-limiting example, the expression of HTT protein and mRNA in the motor cortex is reduced by 59%. As a non-limiting example, the expression of HTT protein and mRNA in the motor cortex is reduced by 60%.

In one embodiment, the siRNA duplexes or encoded dsRNA may be used to reduce the expression of HTT protein and/or mRNA in the somatosensory cortex. The expression of HTT protein and/or mRNA is reduced by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100%, or 95-100%. As a non-limiting example, the expression of HTT protein and mRNA in the somatosensory cortex is reduced by 40-50%. As a non-limiting example, the expression of HTT protein and mRNA in the somatosensory cortex is reduced by 30-70%. As a non-limiting example, the expression of HTT protein and mRNA in the somatosensory cortex is reduced by at least 30%. As a non-limiting example, the expression of HTT protein and mRNA in the somatosensory cortex is reduced by 40-70%. As a non-limiting example, the expression of HTT protein and mRNA in the somatosensory cortex is reduced by 40-50%. As a non-limiting example, the expression of HTT protein and mRNA in the somatosensory cortex is reduced by 50-70%. As a non-limiting example, the expression of HTT protein and mRNA in the somatosensory cortex is reduced by 50-60%. As a non-limiting example, the expression of HTT protein and mRNA in the somatosensory cortex is reduced by 50%. As a non-limiting example, the expression of HTT protein and mRNA in the somatosensory cortex is reduced by 51%. As a non-limiting example, the expression of HTT protein and mRNA in the somatosensory cortex is reduced by 52%. As a non-limiting example, the expression of HTT protein and mRNA in the somatosensory cortex is reduced by 53%. As a non-limiting example, the expression of HTT protein and mRNA in the somatosensory cortex is reduced by 54%. As a non-limiting example, the expression of HTT protein and mRNA in the somatosensory cortex is reduced by 55%. As a non-limiting example, the expression of HTT protein and mRNA in the somatosensory cortex is reduced by 56%. As a non-limiting example, the expression of HTT protein and mRNA in the somatosensory cortex is reduced by 57%. As a non-limiting example, the expression of HTT protein and mRNA in the somatosensory cortex is reduced by 58%. As a non-limiting example, the expression of HTT protein and mRNA in the somatosensory cortex is reduced by 59%. As a non-limiting example, the expression of HTT protein and mRNA in the somatosensory cortex is reduced by 60%.

In one embodiment, the siRNA duplexes or encoded dsRNA may be used to reduce the expression of HTT protein and/or mRNA in the temporal cortex. The expression of HTT protein and/or mRNA is reduced by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%. As a non-limiting example, the expression of HTT protein and mRNA in the temporal cortex is reduced by 40-50%. As a non-limiting example, the expression of HTT protein and mRNA in the temporal cortex is reduced by 30-70%. As a non-limiting example, the expression of HTT protein and mRNA in the temporal cortex is reduced by at least 30%. As a non-limiting example, the expression of HTT protein and mRNA in the temporal cortex is reduced by 40-70%. As a non-limiting example, the expression of HTT protein and mRNA in the temporal cortex is reduced by 40-50%. As a non-limiting example, the expression of HTT protein and mRNA in the temporal cortex is reduced by 50-70%. As a non-limiting example, the expression of HTT protein and mRNA in the temporal cortex is reduced by 50-60%. As a non-limiting example, the expression of HTT protein and mRNA in the temporal cortex is reduced by 50%. As a non-limiting example, the expression of HTT protein and mRNA in the temporal cortex is reduced by 51%. As a non-limiting example, the expression of HTT protein and mRNA in the temporal cortex is reduced by 52%. As a non-limiting example, the expression of HTT protein and mRNA in the temporal cortex is reduced by 53%. As a non-limiting example, the expression of HTT protein and mRNA in the temporal cortex is reduced by 54%. As a non-limiting example, the expression of HTT protein and mRNA in the temporal cortex is reduced by 55%. As a non-limiting example, the expression of HTT protein and mRNA in the temporal cortex is reduced by 56%. As a non-limiting example, the expression of HTT protein and mRNA in the temporal cortex is reduced by 57%. As a non-limiting example, the expression of HTT protein and mRNA in the temporal cortex is reduced by 58%. As a non-limiting example, the expression of HTT protein and mRNA in the temporal cortex is reduced by 59%. As a non-limiting example, the expression of HTT protein and mRNA in the temporal cortex is reduced by 60%.

In one embodiment, the siRNA duplexes or encoded dsRNA may be used to reduce the expression of HTT protein and/or mRNA in the putamen. The expression of HTT protein and/or mRNA is reduced by at least about 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 55-60%, 55-70%, 55-80%, 55-90%, 55-95%, 55-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100% in at least one region of the CNS. As a non-limiting example, the expression of HTT protein and mRNA in the putamen is reduced by 40-70%. As a non-limiting example, the expression of HTT protein and mRNA in the putamen is reduced by 40-50%. As a non-limiting example, the expression of HTT protein and mRNA in the putamen is reduced by 50-70%. As a non-limiting example, the expression of HTT protein and mRNA in the putamen is reduced by 50-60%. As a non-limiting example, the expression of HTT protein and mRNA in the putamen is reduced by 50%. As a non-limiting example, the expression of HTT protein and mRNA in the putamen is reduced by 51%. As a non-limiting example, the expression of HTT protein and mRNA in the putamen is reduced by 52%. As a non-limiting example, the expression of HTT protein and mRNA in the putamen is reduced by 53%. As a non-limiting example, the expression of HTT protein and mRNA in the putamen is reduced by 54%. As a non-limiting example, the expression of HTT protein and mRNA in the putamen is reduced by 55%. As a non-limiting example, the expression of HTT protein and mRNA in the putamen is reduced by 56%. As a non-limiting example, the expression of HTT protein and mRNA in the putamen is reduced by 57%. As a non-limiting example, the expression of HTT protein and mRNA in the putamen is reduced by 58%. As a non-limiting example, the expression of HTT protein and mRNA in the putamen is reduced by 59%. As a non-limiting example, the expression of HTT protein and mRNA in the putamen is reduced by 60%.

Solo and Combination Therapy

In some embodiments, the present composition is administered as a solo therapeutic or combination therapeutics for the treatment of HD.

In some embodiments, the pharmaceutical composition of the present invention is used as a solo therapy. In other embodiments, the pharmaceutical composition of the present invention is used in combination therapy. The combination therapy may be in combination with one or more neuroprotective agents such as small molecule compounds, growth factors and hormones which have been tested for their neuroprotective effect on neuron degeneration.

The AAV particles encoding siRNA duplexes targeting the HTT gene may be used in combination with one or more other therapeutic agents. By "in combination with," it is not intended to imply that the agents must be administered at the same time and/or formulated for delivery together, although these methods of delivery are within the scope of the present disclosure. Compositions can be administered concurrently with, prior to, or subsequent to, one or more other desired therapeutics or medical procedures. In general, each agent will be administered at a dose and/or on a time schedule determined for that agent.

Therapeutic agents that may be used in combination with the AAV particles encoding the nucleic acid sequence for the siRNA molecules of the present invention can be small molecule compounds which are antioxidants, anti-inflammatory agents, anti-apoptosis agents, calcium regulators, antiglutamatergic agents, structural protein inhibitors, compounds involved in muscle function, and compounds involved in metal ion regulation.

Compounds tested for treating HD which may be used in combination with the vectors described herein include, but are not limited to, dopamine-depleting agents (e.g., tetrabenazine for chorea), benzodiazepines (e.g., clonazepam for myoclonus, chorea, dystonia, rigidity, and/or spasticity), anticonvulsants (e.g., sodium valproate and levetiracetam for myoclonus), amino acid precursors of dopamine (e.g., levodopa for rigidity which is particularly associate with juvenile HD or young adult-onset parkinsonian phenotype), skeletal muscle relaxants (e.g., baclofen, tizanidine for rigidity and/or spasticity), inhibitors for acetycholine release at the neuromuscular junction to cause muscle paralysis (e.g., botulinum toxin for bruxism and/or dystonia), atypical neuroleptics (e.g., olanzapine and quetiapine for psychosis and/or irritability, risperidone, sulpiride and haloperidol for psychosis, chorea and/or irritability, clozapine for treatment-resistant psychosis, aripiprazole for psychosis with prominent negative symptoms), agents to increase ATP/cellular energetics (e.g., creatine), selective serotonin reuptake inhibitors (SSRIs) (e.g., citalopram, fluoxetine, paroxetine, sertraline, mirtazapine, venlafaxine for depression, anxiety, obsessive compulsive behavior and/or irritability), hypnotics (e.g., xopiclone and/or zolpidem for altered sleep-wake cycle), anticonvulsants (e.g., sodium valproate and carbamazepine for mania or hypomania) and mood stabilizers (e.g., lithium for mania or hypomania).

Neurotrophic factors may be used in combination therapy with the AAV particles encoding the nucleic acid sequence for the siRNA molecules of the present invention for treating HD. Generally, a neurotrophic factor is defined as a substance that promotes survival, growth, differentiation, proliferation and/or maturation of a neuron, or stimulates increased activity of a neuron. In some embodiments, the present methods further comprise delivery of one or more trophic factors into the subject in need of treatment. Trophic factors may include, but are not limited to, IGF-I, GDNF, BDNF, CTNF, VEGF, Colivelin, Xaliproden, Thyrotrophin-releasing hormone and ADNF, and variants thereof.

In one aspect, the AAV particles comprising modulatory polynucleotides encoding the siRNA duplex targeting the HTT gene may be co-administered with AAV vectors expressing neurotrophic factors such as AAV-IGF-I (See e.g., Vincent et al., Neuromolecular medicine, 2004, 6, 79-85; the content of which is incorporated herein by reference in its entirety) and AAV-GDNF (See e.g., Wang et al., J Neurosci., 2002, 22, 6920-6928; the content of which is incorporated herein by reference in its entirety).

V. Definitions

Unless stated otherwise, the following terms and phrases have the meanings described below. The definitions are not meant to be limiting in nature and serve to provide a clearer understanding of certain aspects of the present invention.

As used herein, the term "nucleic acid", "polynucleotide" and "oligonucleotide" refer to any nucleic acid polymers composed of either polydeoxyribonucleotides (containing 2-deoxy-D-ribose), or polyribonucleotides (containing D-ribose), or any other type of polynucleotide which is an N glycoside of a purine or pyrimidine base, or modified purine or pyrimidine bases. There is no intended distinction in length between the term "nucleic acid", "polynucleotide" and "oligonucleotide", and these terms will be used interchangeably. These terms refer only to the primary structure of the molecule. Thus, these terms include double- and single-stranded DNA, as well as double- and single stranded RNA.

As used herein, the term "RNA" or "RNA molecule" or "ribonucleic acid molecule" refers to a polymer of ribonucleotides; the term "DNA" or "DNA molecule" or "deoxyribonucleic acid molecule" refers to a polymer of deoxyribonucleotides. DNA and RNA can be synthesized naturally, e.g., by DNA replication and transcription of DNA, respectively, or be chemically synthesized. DNA and RNA can be single-stranded (i.e., ssRNA or ssDNA, respectively) or multi-stranded (e.g., double stranded, i.e., dsRNA and dsDNA, respectively). The term "mRNA" or "messenger RNA", as used herein, refers to a single stranded RNA that encodes the amino acid sequence of one or more polypeptide chains.

As used herein, the term "RNA interfering" or "RNAi" refers to a sequence specific regulatory mechanism mediated by RNA molecules which results in the inhibition or interfering or "silencing" of the expression of a corresponding protein-coding gene. RNAi has been observed in many types of organisms, including plants, animals and fungi. RNAi occurs in cells naturally to remove foreign RNAs (e.g., viral RNAs). Natural RNAi proceeds via fragments cleaved from free dsRNA which direct the degradative mechanism to other similar RNA sequences. RNAi is controlled by the RNA-induced silencing complex (RISC) and is initiated by short/small dsRNA molecules in cell cytoplasm, where they interact with the catalytic RISC component argonaute. The dsRNA molecules can be introduced into cells exogenously. Exogenous dsRNA initiates RNAi by activating the ribonuclease protein Dicer, which binds and cleaves dsRNAs to produce double-stranded fragments of 21-25 base pairs with a few unpaired overhang bases on each end. These short double stranded fragments are called small interfering RNAs (siRNAs).

As used herein, the terms "short interfering RNA," "small interfering RNA" or "siRNA" refer to an RNA molecule (or RNA analog) comprising between about 5-60 nucleotides (or nucleotide analogs) which is capable of directing or mediating RNAi. Preferably, a siRNA molecule comprises between about 15-30 nucleotides or nucleotide analogs, such as between about 16-25 nucleotides (or nucleotide analogs), between about 18-23 nucleotides (or nucleotide analogs), between about 19-22 nucleotides (or nucleotide analogs) (e.g., 19, 20, 21 or 22 nucleotides or nucleotide analogs), between about 19-25 nucleotides (or nucleotide analogs), and between about 19-24 nucleotides (or nucleotide analogs). The term "short" siRNA refers to a siRNA comprising 5-23 nucleotides, preferably 21 nucleotides (or nucleotide analogs), for example, 19, 20, 21 or 22 nucleotides. The term "long" siRNA refers to a siRNA comprising 24-60 nucleotides, preferably about 24-25 nucleotides, for example, 23, 24, 25 or 26 nucleotides. Short siRNAs may, in some instances, include fewer than 19 nucleotides, e.g., 16, 17 or 18 nucleotides, or as few as 5 nucleotides, provided that the shorter siRNA retains the ability to mediate RNAi. Likewise, long siRNAs may, in some instances, include more than 26 nucleotides, e.g., 27, 28, 29, 30, 35, 40, 45, 50, 55, or even 60 nucleotides, provided that the longer siRNA retains the ability to mediate RNAi or translational repression absent further processing, e.g., enzymatic processing, to a short siRNA, siRNAs can be single stranded RNA molecules (ss-siRNAs) or double stranded RNA molecules (ds-siRNAs) comprising a sense strand and an antisense strand which hybridized to form a duplex structure called siRNA duplex.

As used herein, the term "the antisense strand" or "the first strand" or "the guide strand" of a siRNA molecule refers to a strand that is substantially complementary to a section of about 10-50 nucleotides, e.g., about 15-30, 16-25, 18-23 or 19-22 nucleotides of the mRNA of the gene targeted for silencing. The antisense strand or first strand has sequence sufficiently complementary to the desired target mRNA sequence to direct target-specific silencing, e.g., complementarity sufficient to trigger the destruction of the desired target mRNA by the RNAi machinery or process.

As used herein, the term "the sense strand" or "the second strand" or "the passenger strand" of a siRNA molecule refers to a strand that is complementary to the antisense strand or first strand. The antisense and sense strands of a siRNA molecule are hybridized to form a duplex structure. As used herein, a "siRNA duplex" includes a siRNA strand having sufficient complementarity to a section of about 10-50 nucleotides of the mRNA of the gene targeted for silencing and a siRNA strand having sufficient complementarity to form a duplex with the other siRNA strand.

As used herein, the term "complementary" refers to the ability of polynucleotides to form base pairs with one another. Base pairs are typically formed by hydrogen bonds between nucleotide units in antiparallel polynucleotide strands. Complementary polynucleotide strands can form base pair in the Watson-Crick manner (e.g., A to T. A to U, C to G), or in any other manner that allows for the formation of duplexes. As persons skilled in the art are aware, when using RNA as opposed to DNA, uracil rather than thymine is the base that is considered to be complementary to adenosine. However, when a U is denoted in the context of the present invention, the ability to substitute a T is implied, unless otherwise stated. Perfect complementarity or 100% complementarity refers to the situation in which each nucleotide unit of one polynucleotide strand can form hydrogen bond with a nucleotide unit of a second polynucleotide strand. Less than perfect complementarity refers to the situation in which some, but not all, nucleotide units of two strands can form hydrogen bond with each other. For example, for two 20-mers, if only two base pairs on each strand can form hydrogen bond with each other, the polynucleotide strands exhibit 10% complementarity. In the same example, if 18 base pairs on each strand can form hydrogen bonds with each other, the polynucleotide strands exhibit 90% complementarity.

As used herein, the term "substantially complementary" means that the siRNA has a sequence (e.g., in the antisense strand) which is sufficient to bind the desired target mRNA, and to trigger the RNA silencing of the target mRNA.

As used herein, "targeting" means the process of design and selection of nucleic acid sequence that will hybridize to a target nucleic acid and induce a desired effect.

The term "gene expression" refers to the process by which a nucleic acid sequence undergoes successful transcription and in most instances translation to produce a protein or peptide. For clarity, when reference is made to measurement of "gene expression", this should be understood to mean that measurements may be of the nucleic acid product of transcription, e.g., RNA or mRNA or of the amino acid product of translation, e.g., polypeptides or peptides. Methods of measuring the amount or levels of RNA, mRNA, polypeptides and peptides are well known in the art.

As used herein, the term "mutation" refers to any changing of the structure of a gene, resulting in a variant (also called "mutant") form that may be transmitted to subsequent generations. Mutations in a gene may be caused by the alternation of single base in DNA, or the deletion, insertion, or rearrangement of larger sections of genes or chromosomes.

As used herein, the term "vector" means any molecule or moiety which transports, transduces or otherwise acts as a carrier of a heterologous molecule such as the siRNA molecule of the invention. A "viral genome" or "vector genome" or "viral vector" refers to a sequence which comprises one or more polynucleotide regions encoding or comprising a molecule of interest, e.g., a transgene, a polynucleotide encoding a polypeptide or multi-polypeptide or a modulatory nucleic acid such as small interfering RNA (siRNA). Viral genomes are commonly used to deliver genetic materials into cells. Viral genomes are often modified for specific applications. Types of viral genome sequence include retroviral viral genome sequences, lentiviral viral genome sequences, adenoviral viral genome sequences and adeno-associated viral genome sequences.

The term "adeno-associated virus" or "AAV" as used herein refers to any vector which comprises or derives from components of an adeno-associated vector and is suitable to infect mammalian cells, preferably human cells. The term AAV vector typically designates an AAV type viral particle or virion comprising a payload. The AAV vector may be derived from various serotypes, including combinations of serotypes (i.e., "pseudotyped" AAV) or from various genomes (e.g., single stranded or self-complementary). In addition, the AAV vector may be replication defective and/or targeted.

As used herein, the phrase "inhibit expression of a gene" means to cause a reduction in the amount of an expression product of the gene. The expression product can be a RNA molecule transcribed from the gene (e.g., an mRNA) or a polypeptide translated from an mRNA transcribed from the gene. Typically a reduction in the level of an mRNA results in a reduction in the level of a polypeptide translated therefrom. The level of expression may be determined using standard techniques for measuring mRNA or protein.

As used herein, the term "in vitro" refers to events that occur in an artificial environment, e.g., in a test tube or reaction vessel, in cell culture, in a Petri dish, etc., rather than within an organism (e.g., animal, plant, or microbe).

As used herein, the term "in vivo" refers to events that occur within an organism (e.g., animal, plant, or microbe or cell or tissue thereof).

As used herein, the term "modified" refers to a changed state or structure of a molecule of the invention. Molecules may be modified in many ways including chemically, structurally, and functionally.

As used herein, the term "synthetic" means produced, prepared, and/or manufactured by the hand of man. Synthesis of polynucleotides or polypeptides or other molecules of the present invention may be chemical or enzymatic.

As used herein, the term "transfection" refers to methods to introduce exogenous nucleic acids into a cell. Methods of transfection include, but are not limited to, chemical methods, physical treatments and cationic lipids or mixtures. The list of agents that can be transfected into a cell is large and includes, but is not limited to, siRNA, sense and/or antisense sequences, DNA encoding one or more genes and organized into an expression plasmid, proteins, protein fragments, and more.

As used herein, "off target" refers to any unintended effect on any one or more target, gene, or cellular transcript.

As used herein, the phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

As used herein, the term "effective amount" of an agent is that amount sufficient to effect beneficial or desired results, for example, clinical results, and, as such, an "effective amount" depends upon the context in which it is being applied. For example, in the context of administering an agent that treats HD, an effective amount of an agent is, for example, an amount sufficient to achieve treatment, as defined herein, of HD, as compared to the response obtained without administration of the agent.

As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition.

As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates such as chimpanzees and other apes and monkey species, and humans) and/or plants.

As used herein, the term "preventing" or "prevention" refers to delaying or forestalling the onset, development or progression of a condition or disease for a period of time, including weeks, months, or years.

The term "treatment" or "treating," as used herein, refers to the application of one or more specific procedures used for the cure or amelioration of a disease. In certain embodiments, the specific procedure is the administration of one or more pharmaceutical agents. In the context of the present invention, the specific procedure is the administration of one or more siRNA molecules.

As used herein, the term "amelioration" or "ameliorating" refers to a lessening of severity of at least one indicator of a condition or disease. For example, in the context of neurodegeneration disorder, amelioration includes the reduction of neuron loss.

As used herein, the term "administering" refers to providing a pharmaceutical agent or composition to a subject.

As used herein, the term "neurodegeneration" refers to a pathologic state which results in neural cell death. A large number of neurological disorders share neurodegeneration as a common pathological state. For example, Alzheimer's disease, Parkinson's disease, Huntington's disease, and amyotrophic lateral sclerosis (ALS) all cause chronic neurodegeneration, which is characterized by a slow, progressive neural cell death over a period of several years, whereas acute neurodegeneration is characterized by a sudden onset of neural cell death as a result of ischemia, such as stroke, or trauma, such as traumatic brain injury, or as a result of axonal transection by demyelination or trauma caused, for example, by spinal cord injury or multiple sclerosis. In some neurological disorders, mainly one type of neuronal cell is degenerative, for example, medium spiny neuron degeneration in early HD.

VI. Equivalents and Scope

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any antibiotic, therapeutic or active ingredient; any method of production; any method of use;

etc.) can be excluded from any one or more claims, for any reason, whether or not related to the existence of prior art.

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

VII. Examples

Example 1. In Vivo YAC128 Mouse Study of HTT Suppression, Guide to Passenger Ratio and Precision of 5' End Processing after Treatment with AAV1-miRNA Vectors Produced in Mammalian Cells Based on in vitro suppression of HTT with plasmid transfection and with infection of AAV packaged AAV-miRNA expression vectors, selected AAV-miRNA expression vectors were packaged in AAV1 and evaluated in vivo in YAC128 mice, to quantify HTT mRNA suppression, and to assess guide to passenger strand ratio and the precision of 5' end processing by deep sequencing. The AAV-miRNA transgene genomes were packaged in AAV1 with a CBA promoter (AAV1.CBA.iHtt), and then, the vectors were produced by triple transfection in HEK293 or HEK293T cells, purified and formulated in phosphate buffered saline (PBS) with 0.001% F-68. The vectors were administered to YAC128 mice 7-12 weeks of age via bilateral intrastriatal infusion at a dose of approximately 1E10 to 3E10 vg in 5 uL over 10 minutes per hemisphere. A control group was treated with vehicle (PBS with 0.001% F-68). Each group comprised 4 females and 4 males. Approximately 28 days following test article administration, striatum tissue punches were collected and snap-frozen for later analysis.

Striatum tissue samples were then homogenized and total RNAs were purified. The relative expression of HTT was determined by qRT-PCR. Housekeeping genes for normalization included mouse XPNPEP1 (X-Prolyl Aminopeptidase 1) and mouse HPRT (hypoxanthine-guanine phosphoribosyltransferase). HTT mRNA was normalized to housekeeping gene expression, and then further normalized to the vehicle group. The total dose (vg/mouse), and constructs are shown in Table 41. The results are shown in Tables 42 and 43.

TABLE 41

Construct and Total Dose

| ITR to ITR Sequence Name (SEQ ID NO) | Modulatory Polynucleotide Construct Name | Modulatory Polynucleotide SEQ ID NO | Total Dose (vg/mouse) |
|---|---|---|---|
| VOYHT43 (SEQ ID NO: 1433) | VOYHTmiR-127.016 | 1253 | 6E10 |
| VOYHT15 (SEQ ID NO: 1366) | VOYHTmiR-127.579 | 1259 | 6E10 |

TABLE 41-continued

Construct and Total Dose

| ITR to ITR Sequence Name (SEQ ID NO) | Modulatory Polynucleotide Construct Name | Modulatory Polynucleotide SEQ ID NO | Total Dose (vg/mouse) |
|---|---|---|---|
| VOYHT38 (SEQ ID NO: 1428) | VOYHTmiR-104.907 | 1219 | 4.91E10 |
| VOYHT37 (SEQ ID NO: 1427) | VOYHTmiR-104.425 | 1231 | 6E10 |
| VOYHT42 (SEQ ID NO: 1432) | VOYHTmiR-116.016 | 1252 | 3.57E10 |
| VOYHT46 (SEQ ID NO: 1436) | VOYHTmiR-127.257 | 1211 | 6E10 |
| VOYHT44 (SEQ ID NO: 1434) | VOYHTmiR-127.218 | 1194 | 6E10 |
| VOYHT39 (SEQ ID NO: 1429) | VOYHTmiR-104.257 | 1207 | 6E10 |
| VOYHT36 (SEQ ID NO: 1426) | VOYHTmiR-102.016 | 1248 | 4.89E10 |
| VOYHT16 (SEQ ID NO: 1367) | VOYHTmiR-104.016 | 1249 | 5.79E10 |
| VOYHT35 (SEQ ID NO: 1388) | VOYHTmiR-104.579 | 1255 | 5.85E10 |
| VOYHT48 (SEQ ID NO: 1438) | VOYHTmiR-104.579.10 | 1347 | 2.65E10 |
| VOYHT40 (SEQ ID NO; 1430) | VOYHTmiR-109.016 | 1250 | 5.91E10 |
| VOYHT41 (SEQ ID NO: 1431) | VOYHTmiR-114.016 | 1251 | 3.76E10 |
| VOYHT45 (SEQ ID NO: 1435) | VOYHTmiR-127.907 | 1223 | 4.71E10 |
| VOYHT47 (SEQ ID NO: 1437) | VOYHTmiR-104.579.3 | 1262 | 3.15E10 |
| Vehicle | N/A | — | — |

TABLE 42

HTT mRNA Suppression in YAC128 Mouse Striatum after Intrastriatal Infusion

| ITR to ITR Sequence Name | Modulatory Polynucleotide Construct Name | Modulatory Polynucleotide SEQ ID NO | Relative HTT mRNA Level (%) (normalized to XPNPEP1) – mean ± standard deviation | Relative HTT mRNA Level (%) (normalized to HPRT) – mean ± standard deviation |
|---|---|---|---|---|
| VOYHT43 | VOYHTmiR-127.016 | 1253 | 63 ± 8 | 68 ± 9 |
| VOYHT44 | VOYHTmiR-127.218 | 1194 | 85 ± 19 | 86 ± 22 |
| VOYHT46 | VOYHTmiR-127.257 | 1211 | 76 ± 13 | 78 ± 8 |
| VOYHT42 | VOYHTmiR-116.016 | 1252 | 99 ± 11 | 106 ± 18 |
| VOYHT15 | VOYHTmiR-127.579 | 1259 | 74 ± 6 | 77 ± 10 |
| VOYHT37 | VOYHTmiR-104.425 | 1231 | 83 ± 4 | 86 ± 7 |
| VOYHT39 | VOYHTmiR-104.257 | 1207 | 91 ± 7 | 96 ± 10 |
| VOYHT38 | VOYHTmiR-104.907 | 1219 | 103 ± 18 | 102 ± 14 |
| Vehicle | N/A | — | 100 ± 15 | 100 ± 14 |

TABLE 43

HTT mRNA Suppression in YAC128 Mouse Striatum after Intrastriatal Infusion

| ITR to ITR Sequence Name | Modulatory Polynucleotide Construct Name | Modulatory Polynucleotide SEQ ID NO | Relative HTT mRNA Level (%) (normalized to XPNPEP1) – mean ± standard deviation | Relative HTT mRNA Level (%) (normalized to HPRT) – mean ± standard deviation |
|---|---|---|---|---|
| VOYHT47 | VOYHTmiR-104.579.3 | 1262 | 67 ± 19 | 63 ± 18 |
| VOYHT48 | VOYHTmiR-104.579.10 | 1347 | 70 ± 10 | 69 ± 10 |
| VOYHT36 | VOYHTmiR-102.016 | 1248 | 92 ± 12 | 91 ± 12 |
| VOYHT16 | VOYHTmiR-104.016 | 1249 | 73 ± 10 | 68 ± 7 |
| VOYHT41 | VOYHTmiR-114.016 | 1251 | 93 ± 9 | 88 ± 16 |
| VOYHT45 | VOYHTmiR-127.907 | 1223 | 87 ± 14 | 83 ± 10 |
| VOYHT40 | VOYHTmiR-109.016 | 1250 | 79 ± 7 | 76 ± 6 |
| VOYHT35 | VOYHTmiR-104.579 | 1255 | 94 ± 16 | 96 ± 13 |
| Vehicle | N/A | — | 100 ± 6 | 100 ± 8 |

In YAC128 mouse striatum, VOYHT43 (VOYHTmiR-127.016), VOYHT46 (VOYHTmiR-127.257), VOYHT15 (VOYHTmiR-127.579), VOYHT47 (VOYHTmiR-104.579.3), VOYHT48 (VOYHTmiR-104.579.10), VOYHT16 (VOYHTmiR-104.016) and VOYHT40 (VOYHTmiR-109.016) caused about 20 to 40% silencing of HTT mRNA at about 28 days after intrastriatal infusion of 1E10 to 3E10 vg per striatum.

Striatum tissue samples were also evaluated for pri-miRNA processing by deep sequencing to assess guide: passenger strand ratio, abundance of guide and passenger strands relative to the total endogenous pool of miRNAs, and precision of processing at the 5'-end of the guide strand. The results are shown in Table 44.

TABLE 44

Deep Sequencing of YAC128 Mouse Striatal Samples after Intrastriatal Infusion

| ITR to ITR Sequence Name | Modulatory Polynucleotide Construct Name | Modulatory Polynucleotide SEQ ID NO | Abundance Relative to Endogenous miRNA Pool (%) | Guide/ Passenger Ratio | % N (Guide) |
|---|---|---|---|---|---|
| VOYHT43 | VOYHTmiR-127.016 | 1253 | 58.13 | 422.9 | 91.5 |
| VOYHT44 | VOYHTmiR-127.218 | 1194 | 1.49 | 2.44 | 96.2 |
| VOYHT46 | VOYHTmiR-127.257 | 1211 | 9.66 | 0.04 | 85.7 |
| VOYHT42 | VOYHTmiR-116.016 | 1252 | 3.09 | 207.8 | 95.9 |
| VOYHT15 | VOYHTmiR-127.579 | 1259 | 0.05 | 24.28 | 83.2 |
| VOYHT37 | VOYHTmiR-104.425 | 1231 | 0.12 | 0.32 | 92.7 |
| VOYHT39 | VOYHTmiR-104.257 | 1207 | 0.07 | 0.38 | 97.1 |
| VOYHT38 | VOYHTmiR-104.907 | 1219 | 6.45 | 2384 | 96.4 |
| VOYHT47 | VOYHTmiR-104.579.3 | 1262 | 0.21 | 40 | 86.8 |
| VOYHT48 | VOYHTmiR-104.579.10 | 1347 | 0.76 | 83 | 89.8 |
| VOYHT36 | VOYHTmiR-102.016 | 1248 | 3.06 | 494 | 86.4 |
| VOYHT16 | VOYHTmiR-104.016 | 1249 | 5.41 | 629 | 86.8 |
| VOYEIT41 | VOYHTmiR-114.016 | 1251 | 1.7 | 256 | 85.8 |
| VOYHT45 | VOYHTmiR-127.907 | 1223 | 51.29 | 163 | 82.9 |
| VOYHT40 | VOYHTmiR-109.016 | 1250 | 1.75 | 135 | 87.1 |
| VOYHT35 | VOYHTmiR-104.579 | 1255 | 0.01 | 19 | 84.9 |

VOYHT43, VOYHT15, VOYHT46, VOYHT48, VOYHT40, and VOYHT47 were shown to have good Htt mRNA knockdown as compared to the other constructs. VOYHT37, VOYHT46. VOYHT44, and VOYHT39 were considered to have a low guide to passenger strand ratio (G:P ratio) as they had a ratio of less than 4. VOYHT43 and VOYHT45 had abundance relative to total miRNA reads which was greater than 10% and considered too high for additional studies. VOYHT48, VOYHT40 and VOYHT47 were selected for additional studies.

Example 2. AAV-miRNA Expression Vectors

The constructs comprising the pri-miRNA cassettes containing guide strands targeting HTT and passenger strands were engineered into AAV-miRNA expression vectors (either ss or sc). The AAV-miRNA expression vector construct from ITR to ITR, recited 5' to 3', comprises a mutant or wild type ITR, a promoter (either a CMV (which includes an SV40 intron or a human betaglobin intron), U6, H1, CBA (which includes a CMVie enhancer, a CB promoter and an SV40 intron or a human betaglobin intron), or CAG promoter (which includes a CMVie enhancer, a CB promoter, and a rabbit betaglobin intron or a human betaglobin intron), the pri-miRNA cassette containing guide strand sequence targeting HTT and passenger strand sequence, a rabbit globin polyA or human growth hormone polyA and wild type ITR. In vitro and in vivo studies are performed to evaluate the pharmacological activity of the AAV-miRNA expression vectors.

Example 3. In Vivo YAC128 Mouse Study of HTT Suppression, Guide to Passenger Strand Ratio and Precision of Processing after Treatment with AAV-miRNA Vectors Produced with the Baculo/Sf9 System Three constructs comprising the pri-miRNA cassettes containing guide strands targeting HTT and passenger strands were engineered into scAAV-miRNA expression vectors designed for baculo/Sf9 production. The scAAV-miRNA expression construct from ITR to ITR, recited 5' to 3', comprised a wild type ITR, a CBA promoter (which includes a CMVie enhancer, a CB promoter and an SV40 intron), the pri-miRNA cassette containing guide strand sequence targeting HTT and passenger strand sequence, a rabbit globin polyA, a stuffer sequence, and wild type ITR. The vectors were produced in the baculo/Sf9 system, purified and formulated in phosphate buffered saline (PBS) with 0.001% F-68, and then administered to YAC128 mice 7-12 weeks of age via bilateral intrastriatal infusion of 5 µL vector at 0.5 µL/min, with a vector concentration of $3.6 \times 10^{12}$ vg/mL, the total dose was $3.6 \times 10^{10}$ vg. A control group was treated with vehicle (PBS with 0.001% F-68). Each group comprised 4 females and 4 males. Approximately 28 days following test article administration, striatum tissue punches were collected and snap-frozen. Striatum tissue samples were homogenized and total RNAs were purified, and the relative expression of HTT mRNA was determined by qRT-PCR. The housekeeping gene for normalization was mouse XPNPEP1 (X-Prolyl Aminopeptidase 1), HTT mRNA was normalized to housekeeping gene expression, and then further normalized to the vehicle group. The HTT mRNA results are shown in Table 45.

TABLE 45

HTT mRNA Suppression in YAC128 Mouse Striatum after Intrastriatal Infusion

| ITR to ITR Sequence Name | Modulatory Polynucleotide Construct Name | Modulatory Polynucleotide SEQ ID NO | Relative HTT mRNA Level (%) (normalized to XPNPEP1) – mean ± standard deviation |
|---|---|---|---|
| VOYHT1 | VOYHTmiR-104.579.3 | 1262 | 56 ± 14 |
| VOYHT3 | VOYHTmiR-109.016 | 1250 | 58 ± 15 |
| VOYHT4 | VOYHTmiR-104.579.10 | 1347 | 57 ± 15 |
| Vehicle | N/A | — | 100 ± 23 |

In YAC128 mouse striatum, VOYHT1 (VOYHTmiR-104.579.3), VOYHT4 (VOYHTmiR-104.579.10), and VOYHT3 (VOYHTmiR-109.016) caused about 42% to 44% silencing of HTT mRNA at about 28 days after intrastriatal infusion of $1.8 \times 10^{10}$ vg per striatum.

Example 4. In Vivo Study in Non-Human Primates

Study Design

A study in rhesus monkeys was conducted to evaluate HTT suppression, precision, and efficiency of pri-miRNA processing, tolerability, and distribution of vector genomes within the CNS. Selected constructs comprising the pri-miRNA cassettes containing guide strands targeting HTT and passenger strands were engineered into scAAV-miRNA expression vectors designed for baculo/Sf9 production. The scAAV-miRNA expression construct from ITR to ITR, recited 5' to 3', comprised a wild type ITR, a CBA promoter (which includes a CMVie enhancer, a CB promoter and an SV40 intron), the pri-miRNA cassette containing guide strand sequence targeting HTT and passenger strand sequence, a rabbit globin polyA, a stuffer sequence, and wild type ITR. The vectors were produced in the baculo/Sf9 system, purified and formulated in phosphate buffered saline (PBS) with 0.001% F-68.

Four groups of rhesus monkeys received vehicle (n=3) or one of three vectors (n=6 per group) as bilateral intraputamenal infusions of 100 µL/side at 3-5 µL/min. Gadoteridol (2 mM; ProHance) was co-infused. For animals receiving a vector, the same vector was infused on both sides, with the right side receiving a concentration of $9 \times 10^{11}$ vg/mL and the left side receiving a concentration of $2.7 \times 10^{12}$ vg/mL. The total dose of vector administered was $9 \times 10^{10}$ vg (low dose) or $2.7 \times 10^{11}$ vg (high dose) per putamen, or $3.6 \times 10^{11}$ vg per animal. All animals were euthanized after five weeks. The study design is shown in Table 46.

TABLE 46

Study Design

| Group | N | ITR to ITR Sequence Name (SEQ ID NO) | Titer (vg/ml) Left (High Dose) | Titer (vg/ml) Right (Low Dose) | Dosing Sites |
|---|---|---|---|---|---|
| 1 | 6 | VOYHT1 (SEQ ID NO: 1352) | 2.7E12 | 0.9E12 | Bilateral putamen infusion via posterior trajectory 100 µl per side |
| 2 | 6 | VOYHT3 (SEQ ID NO: 1354) | 2.7E12 | 0.9E12 | |
| 3 | 6 | VOYHT4 (SEQ ID NO: 1355) | 2.7E12 | 0.9E12 | |
| Control | 3 | | — | — | |

HTT mRNA Analysts

HTT mRNA suppression was evaluated in 2 mm tissue punches from the putamen, using branched DNA (bDNA) for quantifying HTT mRNA levels. For each group receiving vector, a total of 60 punches were evaluated per dose of vector (10 punches per putamen, 6 animals per dose of vector). From the vehicle group, 10 punches per putamen were taken from each of 3 animals. HTT mRNA was normalized to the geometric mean of housekeeping genes TATA-box binding protein (TBP), alanyl-tRNA synthetase (AARS) and X-prolyl aminopeptidase 1 (XPNPEP1), and then further normalized to the vehicle group. The HTT mRNA results are shown in Tables 47 and 48.

TABLE 47

HTT mRNA Suppression in Non-Human Primate Putamen after Intraputamenal Infusion at the High Dose

| Group | N | Titer (vg/ml) Left (High Dose) | Relative HTT mRNA Level (%) (normalized to geometric mean of TBP, AARS and XPNPEP1) – mean ± standard deviation |
|---|---|---|---|
| 1 | 6 | 2.7E12 | 46 ± 11 |
| 2 | 6 | 2.7E12 | 65 ± 9 |
| 3 | 6 | 2.7E12 | 46 ± 10 |
| Control | 3 | — | 100 ± 5 |

TABLE 48

HTT mRNA Suppression in Non-Human Primate Putamen after Intraputamenal Infusion at the Low Dose

| Group | N | Titer (vg/ml) Right (Low Dose) | Relative HTT mRNA Level (%) (normalized to geometric mean of TBP, AARS and XPNPEP1) – mean ± standard deviation |
|---|---|---|---|
| 1 | 6 | 0.9E12 | 60 ± 6 |
| 2 | 6 | 0.9E12 | 76 ± 8 |
| 3 | 6 | 0.9E12 | 62 ± 13 |
| Control | 3 | — | 100 ± 5 |

Vector Genome Quantitation

From the same 2 mm tissue punches from the putamen (with high and low dose treatments) that were used for quantifying HTT mRNA levels by bDNA, a portion of the tissue lysate was used for vector genome copy (VG) determination by droplet digital PCR. For Group 1 (VOYHT1) and Group 3 (VOYHT4), approximately 50% HTT mRNA suppression was achieved with approximately 10 VG copies per diploid cell. For Group 2 (VOYHT3), approximately 50% HTT mRNA suppression was achieved with approximately 400 VG copies per diploid cell. The results are shown in Table 49 (high dose, 2.7E12 vg/mL) and Table 50 (low dose, 0.9E12 vg/mL).

TABLE 49

Vector Genome Copy Number and HTT mRNA Suppression in Non-Human Primate Putamen after Intraputamenal Infusion at the High Dose

| Tissue Punch No. | Group 1 | | Group 2 | | Group 3 | |
|---|---|---|---|---|---|---|
| | Vector Genome Copies/Diploid Cell | Relative HTT mRNA Level (%) | Vector Genome Copies/Diploid Cell | Relative HTT mRNA Level (%) | Vector Genome Copies/Diploid Cell | Relative HTT mRNA Level (%) |
| 1 | 7.17 | 50.8 | 22.52 | 73.9 | 2.46 | 91.7 |
| 2 | 13.35 | 53.3 | 5.56 | 93.4 | 1123.54 | 25.7 |
| 3 | 8.4 | 55.5 | 7.85 | 84.8 | 28.28 | 61.3 |
| 4 | 6.19 | 58.7 | 6.89 | 85.7 | 3.06 | 54.2 |
| 5 | 33.58 | 49.3 | 29.35 | 69.7 | 126.02 | 29.4 |
| 6 | 110.19 | 46.6 | 0.38 | 102.9 | 232.98 | 35.1 |
| 7 | 312.01 | 33.5 | 1408.59 | 28.5 | 59.23 | 78.7 |
| 8 | 645.36 | 38.3 | 410.37 | 62.7 | 2101.49 | 29.3 |
| 9 | 112.5 | 41.2 | 188.99 | 64.3 | 652.06 | 32.9 |
| 10 | 210.8 | 47.9 | 413.03 | 56.7 | 297.66 | 33.6 |
| 11 | 697.33 | 31.7 | 1106.15 | 34.7 | 305.33 | 25.9 |
| 12 | 590.33 | 40.1 | 2.51 | 96.5 | 1167.46 | 38.9 |
| 13 | 40.5 | 52.1 | 277.83 | 54.6 | 1.66 | 80.2 |
| 14 | 9.58 | 36.2 | 94.19 | 74 | 304.93 | 47.5 |
| 15 | 476.2 | 27.8 | 2.81 | 80 | 2.56 | 69.1 |
| 16 | 1803.57 | 30.2 | 960.38 | 25.2 | 26.54 | 52.9 |
| 17 | 4.55 | 52 | 7.98 | 83.3 | 72.32 | 27.5 |
| 18 | 1.52 | 74.9 | 0.6 | 94.9 | 593.8 | 30.6 |
| 19 | 977.99 | 24.4 | 1908.77 | 29.5 | 89.84 | 81.8 |
| 20 | 140.01 | 35.6 | 1252.94 | 34.1 | 536.51 | 31.3 |
| 21 | 1340 | 29.9 | 146.95 | 65.8 | 158.23 | 59.9 |
| 22 | 2208.66 | 31.5 | 1672.46 | 25.8 | 282.82 | 38 |
| 23 | 185.63 | 37.7 | 279.26 | 62.2 | 1493.92 | 21.8 |
| 24 | 31.98 | 69.1 | 1.6 | 89.3 | 598.55 | 31.8 |
| 25 | 793.55 | 34.2 | 547.85 | 64.1 | 2.27 | 84.7 |
| 26 | 2.84 | 83.8 | 657.52 | 48.3 | 35.32 | 97.9 |
| 27 | 1377.78 | 26.1 | 23.98 | 86.2 | 0.79 | 101 |
| 28 | 861.05 | 33.2 | 1479.57 | 19.5 | 48.26 | 75.7 |
| 29 | 5.98 | 67.9 | 2.41 | 96.9 | 233.81 | 42.7 |
| 30 | 1.17 | 93.6 | 0.86 | 97.8 | 56.44 | 67.2 |
| 31 | 40.1 | 40.5 | 16.7 | 93.1 | 73.5 | 39.2 |
| 32 | 1216.3 | 27.4 | 3.8 | 97.9 | 1321.9 | 28.6 |
| 33 | 1.8 | 75.9 | 43.5 | 66.3 | 8.3 | 47.8 |
| 34 | 0.9 | 87.7 | 4.6 | 96.7 | 162.7 | 29.4 |
| 35 | 81.3 | 38.7 | 1665.9 | 23.1 | 24.1 | 43.1 |
| 36 | 192.1 | 44.1 | 642.7 | 35.5 | 505.4 | 40.3 |
| 37 | 1142.9 | 23.9 | 43.3 | 88.8 | 1181.3 | 23.1 |
| 38 | 2046.4 | 25.1 | 23.1 | 104.3 | 2.3 | 96.8 |
| 39 | 1.7 | 89.4 | 1854.5 | 25.9 | 957.4 | 27.4 |
| 40 | 0.4 | 89.2 | 1.6 | 100.8 | 1240 | 23.5 |
| 41 | 1082.2 | 26.1 | 437.9 | 48.9 | 85.3 | 71.3 |
| 42 | 291.8 | 47.7 | 833 | 42.7 | 366.2 | 44.4 |
| 43 | 1327.27 | 25.5 | 698.46 | 59.4 | 1378.13 | 24.7 |
| 44 | 1450 | 24.8 | 478.32 | 80.4 | 614.11 | 37.6 |
| 45 | 327.71 | 55.8 | 1610.13 | 24.4 | 1121.75 | 26.3 |
| 46 | 1.29 | 88.7 | 167.05 | 81.2 | 1496.89 | 29.7 |
| 47 | 1455.07 | 24.8 | 1653.33 | 22.7 | 1133.25 | 22.9 |
| 48 | 1029.21 | 37.2 | 1205.39 | 31.3 | 1251.79 | 31.2 |
| 49 | 870.1 | 24.1 | 35.66 | 92.9 | 983.7 | 28.4 |
| 50 | 98.26 | 35.9 | 56.33 | 89.8 | 1869.84 | 24.9 |
| 51 | 422.46 | 39.4 | 192.11 | 54 | 176.41 | 53.9 |
| 52 | 28.19 | 84.4 | 468.19 | 67.6 | 750.01 | 21.9 |
| 53 | 79 | 42.7 | 2196.15 | 20.5 | 639.03 | 25.4 |
| 54 | 629.63 | 29.6 | 1355.84 | 27.3 | 719.08 | 30.3 |
| 55 | 1296.5 | 24.2 | 1.7 | 103.7 | 1076.8 | 38.5 |
| 56 | 336.7 | 43 | 515.7 | 84.1 | 29.8 | 94.8 |
| 57 | 210.7 | 53.7 | 1348.7 | 31 | 155.6 | 67.3 |
| 58 | 1.3 | 93.2 | 78.7 | 87.7 | 1268.3 | 23.1 |
| 59 | 1832.3 | 26.1 | 398.1 | 60 | 1303.2 | 33.4 |
| 60 | 538.5 | 39.5 | 660.2 | 46.2 | 698.2 | 37 |

TABLE 50

Vector Genome Copy Number and HTT mRNA Suppression in Non-Human Primate Putamen after Intraputamenal Infusion at the Low Dose

| Tissue Punch No. | Group 1 | | Group 2 | | Group 3 | |
|---|---|---|---|---|---|---|
| | Vector Genome Copies/Diploid Cell | Relative HTT mRNA Level (%) | Vector Genome Copies/Diploid Cell | Relative HTT mRNA Level (%) | Vector Genome Copies/Diploid Cell | Relative HTT mRNA Level (%) |
| 61 | 27.8 | 74.5 | 7.5 | 93.4 | 0.3 | 108.2 |
| 62 | 270.4 | 49.2 | 0.8 | 107.1 | 5.8 | 68.3 |
| 63 | 0.5 | 88 | 4.9 | 89.9 | 58.5 | 73.1 |
| 64 | 20.4 | 64 | 2.3 | 99.6 | 73.7 | 47.8 |
| 65 | 1.2 | 78.8 | 1.6 | 98.5 | 9.4 | 72.9 |
| 66 | 3.7 | 90.4 | 1 | 101.8 | 56.6 | 55.1 |
| 67 | 369.6 | 31.2 | 746.5 | 34.2 | 1.1 | 115 |
| 68 | 1082.2 | 34.3 | 0.9 | 116.5 | 890.1 | 26.2 |
| 69 | 420.1 | 34.7 | 420.5 | 45.2 | 384.4 | 40.1 |
| 70 | 702.6 | 29.8 | 138.7 | 65.3 | 431 | 31.4 |
| 71 | 247.6 | 42.3 | 269.6 | 61.3 | 105.2 | 58.9 |
| 72 | 91.7 | 70.3 | 121.9 | 63.7 | 314.3 | 33.5 |
| 73 | 625.3 | 28.1 | 29.2 | 82 | 253.6 | 54.2 |
| 74 | 767.6 | 40.6 | 0.6 | 104.6 | 42.8 | 73.9 |
| 75 | 70 | 60.6 | 0.6 | 94.2 | 0.6 | 103.7 |
| 76 | 1081.7 | 26.4 | 2.5 | 101.8 | 45 | 54.8 |
| 77 | 5 | 67.3 | 7.8 | 88.9 | 0.4 | 91.3 |
| 78 | 0.3 | 91.7 | 0.5 | 103 | 379.2 | 36.7 |
| 79 | 646.9 | 28.4 | 405.4 | 65.9 | 143.7 | 82.5 |
| 80 | 30.5 | 86.9 | 66 | 105.8 | 318.5 | 46.3 |
| 81 | 501.8 | 29.5 | 58.4 | 90.1 | 10.5 | 82 |
| 82 | 811 | 34.1 | 171.2 | 69.4 | 81.3 | 59.8 |
| 83 | 1066.7 | 26.4 | 275.5 | 60.8 | 15.3 | 89.4 |
| 84 | 97.9 | 81.7 | 88.1 | 77 | 899.2 | 26.9 |
| 85 | 405.3 | 42 | 34.4 | 97.7 | 0.3 | 115.8 |
| 86 | 0.5 | 100.2 | 2.4 | 111.6 | 144.9 | 82 |
| 87 | 36.5 | 80.6 | 6.3 | 95.5 | 0.5 | 103.7 |
| 88 | 263.8 | 49.7 | 13.4 | 96.9 | 8.5 | 82.3 |
| 89 | 544.3 | 25.2 | 6.4 | 96.6 | 0.2 | 104.5 |
| 90 | 0.7 | 93.8 | 0.3 | 97 | 229.3 | 49 |
| 91 | 0.2 | 94.3 | 9.1 | 88.9 | 0.4 | 102.1 |
| 92 | 465.1 | 42.5 | 5.4 | 94.8 | 4.3 | 87.6 |
| 93 | 3.6 | 76.6 | 631.9 | 42 | 51.4 | 71.7 |
| 94 | 0.3 | 86.8 | 6.4 | 93.3 | 35.4 | 59.2 |
| 95 | 2 | 90 | 14.5 | 90.9 | 204.1 | 40.6 |
| 96 | 62.4 | 60.5 | 10.7 | 96.1 | 0.7 | 97.2 |
| 97 | 0.2 | 95.3 | 31.7 | 92.9 | 42.1 | 92.4 |
| 98 | 18.2 | 84.6 | 445.6 | 69.1 | 4.3 | 103.2 |
| 99 | 476.8 | 28.1 | 471.3 | 43.3 | 875.3 | 24.5 |
| 100 | 0.1 | 91.9 | 773 | 26.5 | 896.6 | 26.2 |
| 101 | 4.5 | 96.9 | 67.8 | 79.7 | 862.3 | 22.4 |
| 102 | 525.2 | 31.5 | 671 | 39.3 | 311.2 | 45.3 |
| 103 | 64.3 | 80.8 | 1077.2 | 28.3 | 593.2 | 43.7 |
| 104 | 265.4 | 51.1 | 693.7 | 50 | 190.2 | 67.6 |
| 105 | 754.9 | 25.4 | 774.7 | 35.1 | 843.5 | 24.2 |
| 106 | 67.2 | 79.3 | 1063.2 | 28 | 767.5 | 27 |
| 107 | 147.9 | 61 | 520.1 | 54.4 | 899.4 | 23.7 |
| 108 | 545.6 | 32.8 | 478.8 | 48.7 | 686.1 | 27.1 |
| 109 | 130.3 | 66.1 | 676.9 | 29.8 | 626 | 27.2 |
| 110 | 246.8 | 43.4 | 6.3 | 96.9 | 1.6 | 103.1 |
| 111 | 194.5 | 42.1 | 264.6 | 54.8 | 12.1 | 86.4 |
| 112 | 18.7 | 85.4 | 134.3 | 65.3 | 5.1 | 62.9 |
| 113 | 25.7 | 77 | 23.7 | 90.6 | 28.3 | 73.3 |
| 114 | 277.9 | 32.7 | 4.2 | 95.7 | 169.9 | 50.4 |
| 115 | 2.4 | 102.2 | 11.6 | 101.6 | 768.8 | 27.2 |
| 116 | 31.3 | 89.6 | 1062.7 | 44.8 | 14.3 | 99.6 |
| 117 | 666.6 | 27.2 | 145.4 | 71.9 | 311.3 | 49.8 |
| 118 | 0.3 | 93.7 | 213.6 | 80 | 534.6 | 35 |
| 119 | 657.8 | 25 | 463.3 | 46.6 | 414.8 | 33.9 |
| 120 | 471.8 | 30.6 | 170.8 | 69.4 | 785.8 | 24.2 |

Pri-miRNA Processing

Precision and efficiency of pri-miRNA processing were evaluated by deep sequencing of 2 mm punches from the putamen, from the high and low dose treatments, to assess guide:passenger strand ratio, abundance of guide and passenger strands relative to the total endogenous pool of miRNAs, and precision of processing at the 5'-end of the guide strand. These results are shown in Table 51.

TABLE 51

Deep Sequencing in Non-Human Primate Putamen after Intraputamenal Infusion

| Group | Titer (vg/ml) | Abundance Relative to Endogenous miRNA Pool (%) | Guide/ Passenger Ratio | % N (Guide) |
|---|---|---|---|---|
| 1 | High (2.7E12) | 2.2 | 376 | 98 |
|   | Low (0.9E12) | 0.35 | 424 | 97 |
| 2 | High (2.7E12) | 0.23 | 147 | 96 |
|   | Low (0.9E12) | 0.21 | 136 | 96 |
| 3 | High (2.7E12) | 3.54 | 44 | 98 |
|   | Low (0.9E12) | 1.53 | 46 | 97 |

Tolerability Results

Body weight assessments were acquired on Day −8 (i.e., 8 days prior to dosing of the first animal), Day 1, and each week thereafter until termination on Day 36±3. There was no significant change in the average body weights in each group throughout the 5 week in-life period.

Cage-side observations were performed twice daily (a.m. and p.m.) beginning on Day −8 until scheduled necropsy, to assess abnormalities including neurological signs, and signs of pain or distress, as well as changes in general health, appearance, and behavior. In addition, beginning on Day −8, food consumption was assessed qualitatively once per day. Only decreased appetence was noted in a few animals following surgery, this is considered a common finding post-surgery. Food consumption returned to normal within the first week and remained normal for the remainder of the study.

Blood was collected on Day −8, Day 15±2, and Day 36±3 for evaluation of hematology, serum chemistry, and coagulation. Hematology assessments comprised WBC, RBC, HGB, HCT, MCV, MCH, MCHC, PLT (qualitative assessment), and absolute and relative values for NEUT. LYMPH, MONO, EOS, and BASO. Serum chemistry comprised TP, ALB, GLOB, A/G ratio, ALP ALT, AST, TBIL (direct and indirect), BUN, CREAT, Ca CHOL, GLU, Phos, TCO2, Na, K and Cl. Coagulation comprised PT, A-PT and fibrinogen. Although some values fell outside of the normal limits, they were interpreted as physiological variations in the absence of any clinical correlation during in-life.

At necropsy, no abnormalities in gross pathology were observed.

Histopathology was conducted on the putamen including the infusion site. For all animals, a 3 mm thick coronal brain slab containing the putamen was fixed by immersion in 4% paraformaldehyde for 72 to 96 hours at room temperature and then transferred to phosphate buffered saline (PBS) for storage at approximately +4 degC. The 3 mm brain slabs were then embedded in paraffin and coronally sectioned. Full coronal sections, 5 um thick, containing the infusion site in the putamen were assessed for pathology by standard hematoxylin and eosin staining. The vehicle control group was consistent with what would be expected to occur with any injection into the putamen. i.e. the reactions were typical for those associated with a needle track. In Groups 1, 2, and 3, each animal treated with one of three vectors exhibited pathology findings comprised of mild focal gliosis from the needle track, minimal to mild perivascular infiltrates and/or occasional edema most likely due to a combination of trauma from the injection and reaction to the AAV. There were no pathology findings that were considered adverse, given the absence of clinical symptoms.

Example 5. Activity of Vectors with Filler Sequences

The miRNA expression vectors encoding VOYHTmiR-104.579.3 (SEQ ID NO: 1262) or VOYHTmiR-104.016 (SEQ ID NO: 1249) were packaged in AAV1, and infected into HEK293T cells. For HEK293T, the cells were plated into 96-well plates (2.5E4 cells/well in 100 ul cell culture medium) and infected with the miRNA expression vectors. 48 hours after infection, the cells were harvested for immediate cell lysis, RNA isolation and qRT-PCR. The MOI and the results for the vectors and the description of the vectors tested are shown in Table 52. In Table 52, SC means self-complementary vector and SS means single-stranded.

TABLE 52

Knockdown of HTT naRNA

| No. | Modulatory Polynucleotide Name | Sequence Name | Promoter | Length of Construct (ITR to ITR) | SC or SS | Filler SEQ (Y/N) | Relative Htt mRNA Level (%) (normalized to GFP Control) 1E3 | 1E4 | 1E5 |
|---|---|---|---|---|---|---|---|---|---|
| 13 | VOYHTmiR-104.579.3 | VOYHT1 | CBA | 2301 nt | SC | Y | 51 | 15 | 13 |
| 14 | VOYHTmiR-104.579.3 | VOYHT6 | CBA | 2299 nt | SC | Y | 54 | 17 | 12 |
| 15 | VOYHTmiR-104.579.3 | VOYHT10 | CBA | 2307 nt | SC | Y | 88 | 63 | 30 |
| 16 | VOYHTmiR-104.579.3 | VOYHT13 | CBA | 1587 nt | SC | N | 47 | 30 | 12 |
| 17 | VOYHTmiR-104.016 | VOYHT14 | CBA | 1582 nt | SC | N | 86 | 43 | 30 |
| 18 | VOYHTmiR-104.016 | VOYHT25 | CMV | 2198 nt | SC | N | 49 | 41 | 16 |
| 19 | VOYHTmiR-104.579.3 | VOYHT26 | CMV | 2203 nt | SC | N | 32 | 16 | 9 |
| 20 | VOYHTmiR-104.579.3 | VOYHT22 | CMV | 2300 nt | SC | Y | 74 | 26 | 12 |
| 21 | VOYHTmiR-104.579.3 | VOYHT18 | CMV | 2308 nt | SC | Y | 32 | 17 | 10 |
| 22 | VOYHTmiR-104.579.3 | VOYHT20 | CMV | 2306 nt | SC | Y | 45 | 19 | 7 |
| 23 | VOYHTmiR-104.579.3 | VOYHT24 | CMV | 2314 nt | SC | Y | 65 | 22 | 12 |
| 24 | VOYHTmiR-104.579.3 | VOYHT2 | CBA | 4608 nt | SS | Y | 106 | 58 | 27 |
| 25 | VOYHTmiR-104.579.3 | VOYHT5 | CBA | 4606 nt | SS | Y | 132 | 68 | 41 |
| 26 | VOYHTmiR-104.579.3 | VOYHT9 | CBA | 4616 nt | SS | Y | 93 | 56 | 19 |
| 27 | VOYHTmiR-104.579.3 | VOYHT21 | CMV | 4598 nt | SS | Y | 114 | 85 | 26 |

TABLE 52-continued

Knockdown of HTT naRNA

| No. | Modulatory Polynucleotide Name | Sequence Name | Promoter | Length of Construct (ITR to ITR) | SC or SS | Filler SEQ (Y/N) | Relative Htt mRNA Level (%) (normalized to GFP Control) | | |
|---|---|---|---|---|---|---|---|---|---|
| | | | | | | | 1E3 | 1E4 | 1E5 |
| 28 | VOYHTmiR-104.579.3 | VOYHT17 | CMV | 4606 nt | SS | V | 128 | 54 | 20 |
| 29 | VOYHTmiR-104.579.3 | VOYHT19 | CMV | 4608 nt | SS | Y | 53 | 72 | 25 |
| 30 | VOYHTmiR-104.579.10 | VOYHT4 | CBA | 2301 nt | SS | Y | 63 | 61 | 14 |
| 31 | VOYHTmiR-104.579.10 | VOYHT48 | CBA | 1352 nt | | N | 49 | 26 | 10 |

The miRNA expression vectors which were approximately 2300 nucleotides in length had a higher genome quality as compared to the vectors having approximately 1500 nucleotides or 1900 nucleotides. CBA and CMV promoters produced similar levels of knockdown in vitro. Self-complementary vectors produced the highest levels of knockdown in vitro.

Example 6. Quality Control of Vectors Produced with the Baculo/Sf9 System in Large Scale The miRNA expression vectors of the present disclosure were produced by using a Baculo/Sf9 system on a IL scale. A cesium chloride (CsCl) gradient analysis was used in addition to standard purification techniques to ensure a high % of full vectors. The achieved % of full vectors was at least 80%. Titers ranged from 0.9E12 to 4E13 vg/L of culture, and the vectors with a 5' or 3' filler sequence vectors presented the highest titers. The quality of the genome packaged in the vectors of the present disclosure was evaluated by using alkaline denaturing gel analysis, showing a high level of genome quality. The gel banding patterns for the IL scale production was similar to the small scale production pattern. The purity of the vectors of the present invention was evaluated by using silver stain PAGE analysis, showing good VP1, VP2, and VP3 ratio and purity.

The miRNA expression vectors encoding VOYHTmiR-104.579.3, VOYHTmiR-104.579.10, and VOYHTmiR-109.016 were packaged in AAV1, and infected into HEK293T cells. For HEK293T, the cells were plated into 96-well plates (2.5E4 cells/well in 100 ul cell culture medium) and infected with the miRNA expression vectors. 60 hours after infection, the cells were harvested for immediate cell lysis, RNA isolation and qRT-PCR and the levels of HTT were calculated compared to a GFP transduction control. The MOI and the results for the vectors and the description of the vectors tested are shown in Table 53. In Table 53, SC means self-complementary vector.

TABLE 53

Knockdown of HTT naRNA

| No. | Modulatory Polynucleotide Name | Sequence Name | Promoter | Length of Construct (ITR to ITR) | SC or SS | Filler SEQ (Y/N) | Relative Htt mRNA Level (%) (normalized to GFP Control) | | |
|---|---|---|---|---|---|---|---|---|---|
| | | | | | | | 1E3 | 1E4 | 1E5 |
| 14 | VOYHTmiR-104.5793 | VOYHT6 | CBA | 2.3kb | SC | Y | 81 | 39 | 16 |
| 32 | VOYHTmiR-109.016 | VOYHT7 | CBA | 2.3kb | SC | Y | 74 | 59 | 27 |
| 33 | VOYHTmiR-104.579.10 | VOYHT8 | CBA | 2.3kb | SC | Y | 66 | 35 | 17 |
| 13 | VOYHTmiR-104.579.3 | VOYHT1 | CBA | 2.3kb | SC | Y | 81 | 39 | 15 |
| 34 | VOYHTmiR-109.016 | VOYHT3 | CBA | 2.3kb | SC | Y | 75 | 44 | 21 |
| 30 | VOYHTmiR-104.579.10 | VOYHT4 | CBA | 2.3kb | SC | Y | 58 | 31 | 14 |
| 15 | VOYHTmiR-104.579.3 | VOYHT10 | CBA | 2.3kb | SC. | Y | 77 | 83 | 24 |

A dose dependent knockdown was observed for most of the constructs. Self-complementary vectors produced highest levels of knockdown in vitro compared to single-stranded vectors. Vectors with 5' or 3' filler sequences presented higher levels of knockdown in vitro compared to vectors with split filler sequences.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

SEQUENCE LISTING (2260 sequences)

SEQ ID NO: 1 - DNA, 2211 bp, Adeno-associated virus 1
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 2 - protein, 736 aa, Adeno-associated virus 1
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 3 - DNA, 4718 bp, Adeno-associated virus 1
ttgcccactccctctctgcgcgctcgctcgctcggtggggcctgcggaccaaaggtccgcagacggcagagctctgctctgccggccccaccgagcgagcgagcgcgcagagagggagtgggcaactccatcactaggggtaatcgcgaagcgcctcccacgctgccgcgtcagcgctgacgtaaattacgtcataggggagtggtcctgtattagctgtcacgtgagtgcttttgcgacattttgcgacaccacgtggccatttagggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgagctgggtggccgagaaggaatgggagctgcccccggattctgacatggatctgaatctgattgagcaggcacccctgaccgtggccgagaagctgcagcgcgacttcctggtccaatggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcctgtttgaacctggccgagcgcaaacggctcgtggcgcagcacctgacccacgtcagccagacccaggagcagaacaaggagaatctgaaccccaattctgacgcgcctgtcatccggtcaaaaacctccgcgcgctacatggagctggtcgggtggctggtggaccggggcatcacctccgagaagcagtggatccaggaggaccaggcctcgtacatctccttcaacgccgcttccaactcgcggtcccagatcaaggccgctctggacaatgccggcaagatcatggcgctgaccaaatccgcgcccgactacctggtaggccccgctccgcccgcggacattaaaaccaaccgcatctaccgcatcctggagctgaacggctacgaacctgcctacgccggctccgtctttctcggctgggcccagaaaaggttcgggaagcgcaacaccatctggctgtttgggccggccaccacgggcaagaccaacatcgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggacgagagactgttcagagtgcttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaattacgtgttaatcaataaaccggttgattcgtttcagttgaactttggtctcctgtccttcttatcttatcggttaccatggttatagcttacacattaactgcttggttgcgcttcgcgataaaagacttacgtcatcgggttacccctagtgatggagttgcccactccctctctgcgcgctcgctcgctcggtggggcctgcggaccaaaggtccgcagacggcagagctctgctctgccggccccaccgagcgagcgagcgcgcagagagggagtgggcaa

SEQ ID NO: 4 - DNA, 3131 bp, Adeno-associated virus
gcggccgcgaattcgcccttggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcggaatttcaacatttgcttcacacacggggtcagagactgctcagagtgtttccccggcgtgtcagaatctcaaccggtcgtcagaaagaggacgtatcggaaactccgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcttacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacctttcaccacgtgactggcagcgactcatcaacaacaactggggattccgacccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgtccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagctagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctataagtgtggactttgctgttaatacagaaggcgtgtactctgaaccccgccccattggcacccgttacctcacccgtaatctgtaattgcctgttaatcaataaaccggttgattcgtttcagttgaactttggtctctgcgaagggcgaattc

SEQ ID NO: 5 - DNA, 255 bp, Adeno-associated virus 10
ggtaattcctccggaaattggcattgcgattccacatggctgggcgacagagtcatcaccaccagcacccgaacctgggtcctgcccacctacaacaaccacatctacaagcaaatctccagcgagacaggagccaccaacgacaaccactacttcggctacagcaccccctgggggtattttgactttaacagattccactgccacttttcaccacgtgactggcagcgactcatcaacaacaactggggattc

SEQ ID NO: 6 - protein, 738 aa, Adeno-associated virus 10
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGESESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 7 - protein, 738 aa, Adeno-associated virus 10
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 8 - DNA, 258 bp, Adeno-associated virus 11
ggtaattcctccggaaattggcattgcgattccacatggctgggcgacagagtcatcaccaccagcacccgaacctgggccctgccaacctacaacaaccacctctacaaacaaatctccagcgcttcaacgggggccagcaacgacaaccactactttggctacagcaccccctgggggtattttgactttaacagattccactgccacttctcaccacgtgactggcagcgactcatcaacaacaactggggattc

SEQ ID NO: 9 - DNA, 255 bp, Adeno-associated virus 12
ggtaattcctccggaaattggcattgcgattccacatggctgggcgaccgagtcattaccaccagcacccggacttgggccctgcccacctacaacaaccacctctacaagcaaatctccagccaatcgggtgccaccaacgacaaccactacttcggctacagcaccccttgggggtattttgatttcaacagattccactgccatttctcaccacgtgactggcagcgactcatcaacaacaactggggattc

SEQ ID NO: 10 - DNA, 2208 bp, Adeno-associated virus 2
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 11 - protein, 735 aa, Adeno-associated virus 2 [sequence omitted]

SEQ ID NO: 12 - protein, 621 aa, Adeno-associated virus 2
MPGFYEIVIKVPSDLDGHLPGISDSFVNWVAEKEWELPPDSDMDLNLIEQAPLTVAEKLQRDFLTEWRRVSKAPEALFFVQFEKGESYFHMHVLVETTGVKSMVLGRFLSQIREKLIQRIYRGIEPTLPNWFAVTKTRNGAGGGNKVVDECYIPNYLLPKTQPELQWAWTNMEQYLSACLNLTERKRLVAQHLTHVSQTQEQNKENQNPNSDAPVIRSKTSARYMELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRYQNKCSRHVGMNLMLFPCRQCERMNQNSNICFTHGQKDCLECFPVSESQPVSVVKKAYQKLCYIHHIMGKVPDACTACDLVNVDLDDCIFEQ

SEQ ID NO: 13 - DNA, 4675 bp, Adeno-associated virus 2
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgtacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctccggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccggccatggcaagccacaaggacgatgaagaaaagttttttcctcagagcggggttctcatctttgggaagcaaggctcagagaaaacaaatgtgaacattgaaaaggtcatgattacagacgaagaggaaatcggaacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacacggtcagcgtggagatcgagtgggagctgcagaaggaaaacagcaaacgctggaatcccgaaattcagtacacttccaactacaacaagtctgttaatcgtggacttaccgtggatactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 14 - DNA, 4679 bp, Adeno-associated virus 2
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctccggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 15 - protein, 725 aa, Adeno-associated virus 5
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPTTGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 16 - protein, 644 aa, Artificial Sequence
  Description of Artificial Sequence: Synthetic polypeptide
  MOD_RES (434)..(434): Xaa = any amino acid
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNXRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 17 - DNA, 1933 bp, Adeno-associated virus
caaggcctacgaccagcagctcaaagcgggtgacaatccgtacctgcggtataaccacgccgacgccgagtttcaggagtgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggttgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttctccccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacgccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 18 - protein, 644 aa, Artificial Sequence
  Description of Artificial Sequence: Synthetic polypeptide
KAYDQQLKAGDNPYLRYNHADAEFQECLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMVAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFSPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 19 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagccagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacacggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggcgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctgggccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgaatgggagctgcagaaagagaacagcaagcgctggaacccagagattcagtacacctccaactttgacaaacagactggagtggactttgctgttgacagccagggtgtttactctgagcct

SEQ ID NO: 20 - protein, 644 aa, Artificial Sequence
  Description of Artificial Sequence: Synthetic polypeptide
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSEPVPDPQPIGEPPAGPSGLGSGTMAAGGGAPMADNNEGADGVGNASGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLGRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 21 - DNA, 1933 bp, Adeno-associated virus; identical to SEQ ID NO: 19

SEQ ID NO: 22 - protein, 644 aa, Artificial Sequence; identical to SEQ ID NO: 20
  Description of Artificial Sequence: Synthetic polypeptide

SEQ ID NO: 23 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaatagcgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagcttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 24 - protein, 644 aa, Artificial Sequence
  Description of Artificial Sequence: Synthetic polypeptide
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNSEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKLASFITQYSTGQVSVEIEWELQKENSKRWNPEIQYTSNFDKQTGVDFAVDSQGVYSEP

SEQ ID NO: 25 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggcgtcacaaccatcgctaataaccttaccagcacggttcaggtcttttcggacccggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagattgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 26 - protein, 644 aa, Artificial Sequence
  Description of Artificial Sequence: Synthetic polypeptide
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDPEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKIASFITQYSTGQVSVEIEWELQKENSKRWNPEIQYTSNFDKQTGVDFAVDSQGVYSEP

SEQ ID NO: 27 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSTTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSARQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKGNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 28 - DNA, 3121 bp, Adeno-associated virus
gaattcgcccttctacggctgcgtcaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcacgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgcgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcgatgtggatttggatgactgcatctttgaacaataaatgatttaaatcaggtatggctgccgatggttatcttccagattggctcgaggacaacctctctgagggcattcgcgagtggtgggcgctgaaacctggagccccgaagcccaaagccaaccagcaaaagcaggacggcggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgactgagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagtaacgcgtctccacgacactgtcgcaaaataacaacagcaactttgtctggaccggtgccaccaagtatcatctgaatggcagagactctctggtagatcccggtgtcgctatggcaacccacaaggacgacgaagagcgattttttccgtccagcggagtcataatgtttgggaaacagggagctggaaaagacaacgtggactatagcagcgtcatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctacctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcaggaagaaaacagcaaacgctggaacccagagattcaatacacttccaactactacaaatctacaaatgtggactttgctgttaacacagatggcacttattctgagcctcgccccatcggcacccgttacctcacccgtaatctgtaattgcttgttaatcaataaaccggttgattcgtttcagttgaactttggtctctgcgaagggcgaattc

SEQ ID NO: 29 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDGVITTSTRTWALPTYNNHLYKQISNGTSGGSTNDNTYFGYSTPWGYFDFNRFHCHFSPRDWQRLINNNWGFRPKSLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNDNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 30 - DNA, 3121 bp, Adeno-associated virus
gaattcgcccttcgcgagaccaaagttcaactgaaacgaatcaaccggtttattgattaacaagcaattacagattacgggtgaggtaacgggtgccgatggggcgaggctcagaataagtgccatctgtgttaacagcaaagtccacatttgtagatttgtagtagttggaagtgtattgaatctctgggttccagcgtttgctgttttctttctgcagctcccattcaatttccacgctgacctgtccggtgctgtactgcgtgatgaacgacgccagcttagcttgactgaaggtagttggaggatccgcgggaacaggtgtattcttaatcaggatctgaggaggcgggtgtttcagtccaaagcctcccatcagcggcgagggatgaaagtttccgtccgtgtgaggaatcttggcccagataggaccctgcaggtacacgtcccggttctgccagaccatgccaggtaaggctccttgactgttgacggcccctacaataggagcggcgttttgctgttgcaggttatcggccaccacgccgtactgttctgtggccactgggttggtggttttaatttcttcctcactggttagcataacgctgctatagtccacgttgtcttttccagctccctgtttcccaaacattaagactccgctggacggaaaaaatcgctcttcgtcgtccttgtgggttgccatagcgacaccgggatttaccagagagtctctgccattcagatgatacttggtggcaccggtccaggcaaagttgctgttgtcattttgcgacagtgtcgtggagacgcgttgctgccggtagcagggcccgggtagccagtttttggcctgagccgacatgttattaggcccggcctgagaaaatagcaactgctgagttcctgcggtacctcccgtggactgagtccgagacaggtagtacaggtactggtcgatgagggggttcatcagccggtccaggctttggctgtgcgcgtagctgctgtgaaaaggcacgtcctcaaactggtagctgaactcaaagttgttgcccgttctcagcatttgagaaggaaagtactccaggcagtagaaggaggaacggcccacggcctgactgccattgttcagagtcaggtacccgtactgaggaatcatgaagacgtccgccgggaacggaggcaggcagccctggtgcgcagagccgaggacgtacgggagctggtattccgagtccgtaaagacctgaatcgtgctggtaaggttattggcgatggtcttggtgccttcattctgcgtgacctccttgacctggatgttgaagagcttgaagttgaggctcttgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgaagtcccgttggagatttgcttgtagaggtggttgttgtaggtggggagggcccaggttcgggtgctggtggtgatgactccgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctttcttgccgatgcccgtagaggagtctggagaacgctggggtgatggctctaccggtctcttctttccaggagccgtcttagcgccttcctcaaccagaccgagaggttcgagaacccgcttcttggcctggaagactgctcgcccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggcttcggggctccaggtttcagcgcccaccactcgcgaatgccctcagagaggttgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaaagggcgaattc

SEQ ID NO: 31 - DNA, 2211 bp, Adeno-associated virus
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtga

SEQ ID NO: 32 - protein, 736 aa, Adeno-associated virus 3
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKGAVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVRGVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTGTVNHQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 33 - DNA, 4726 bp, Adeno-associated virus 3
ttggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcgcctgccgggcatttctaactcgtttgttaactgggtggccgagaaggaatgggacgtgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttgaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacgggagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtgaatcctggttaatcaataaaccgtttaattcgtttcagttgaactttggctcttgtgcacttctttatctttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggcctggcgaccaaaggtcgccagacggacgtgctttgcacgtccggccccaccgagcgagcgagtgcgcatagagggagtggccaa

SEQ ID NO: 34 - protein, 737 aa, Artificial Sequence
  Description of Artificial Sequence: Synthetic polypeptide
MAADGYLPDWLEDNLSEGIREWWDLKPGAPKPKANQQKQDNGRGLVLPGYKYLGPFNGLDKGEPVNAADAAALEHDKAYDQQLNAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYEQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSDPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWDPEIQYTSNFEKQTGVDFAVDSQGVYSEPRPIGTRYLTRNL

SEQ ID NO: 35 - DNA, 2211 bp, Adeno-associated virus
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 36 - protein, 736 aa, Adeno-associated virus; identical to SEQ ID NO: 32

SEQ ID NO: 37 - protein, 736 aa, Adeno-associated virus 3A; identical to SEQ ID NO: 32

SEQ ID NO: 38 - protein, 624 aa, Adeno-associated virus 3A
MPGFYEIVLKVPSDLDERLPGISNSFVNWVAEKEWDVPPDSDMDPNLIEQAPLTVAEKLQREFLVEWRRVSKAPEALFFVQFEKGETYFHLHVLIETIGVKSMVVGRYVSQIKEKLVTRIYRGVEPQLPNWFAVTKTRNGAGGGNKVVDDCYIPNYLLPKTQPELQWAWTNMDQYLSACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGSNPPEDITKNRIYQILELNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIEPTPVIVTSNTNMCAVIDGNSTTFEHQQPLQDRMFEFELTRRLDHDFGKVTKQEVKDFFRWASDHVTDVAHEFYVRKGGAKKRPASNDADVSEPKRECTSLAQPTTSDAEAPADYADRYQNKCSRHVGMNLMLFPCKTCERMNQISNVCFTHGQRDCGECFPGMSESQPVSVVKKKTYQKLCPIHHILGRAPEIACSACDLANVDLDDCVSEQ

SEQ ID NO: 39 - protein, 736 aa, Adeno-associated virus 3B
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 40 - protein, 624 aa, Adeno-associated virus 3B
MPGFYEIVLKVPSDLDEHLPGISNSFVNWVAEKEWELPPDSDMDPNLIEQAPLTVAEKLQREFLVEWRRVSKAPEALFFVQFEKGETYFHLHVLIETIGVKSMVVGRYVSQIKEKLVTRIYRGVEPQLPNWFAVTKTRNGAGGGNKVVDDCYIPNYLLPKTQPELQWAWTNMDQYLSACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGSNPPEDITKNRIYQILELNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIEPTPVIVTSNTNMCAVIDGNSTTFEHQQPLQDRMFKFELTRRLDHDFGKVTKQEVKDFFRWASDHVTDVAHEFYVRKGGAKKRPASNDADVSEPKRQCTSLAQPTTSDAEAPADYADRYQNKCSRHVGMNLMLFPCKTCERMNQISNVCFTHGQRDCGECFPGMSESQPVSVVKKKTYQKLCPIHHILGRAPEIACSACDLANVDLDDCVSEQ

SEQ ID NO: 41 - DNA, 4722 bp, Adeno-associated virus 3B
tggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcacctgccgggcatttctaactcgtttgttaactgggtggccgagaaggaatgggagctgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttaaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacggcagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaatcctggttaatcaataaaccgtttaattcgtttcagttgaactttggctcttgtgcacttcttatcttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggccggacgtgcaaagcacgtccgtctggcgacctttggtcgccaggccccaccgagcgagcgagtgcgcatagagggagtggccaa

SEQ ID NO: 42 - DNA, 1800 bp, Adeno-associated virus 4
  misc_feature (342)..(342): n is a, c, t, or g
acggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataa

SEQ ID NO: 43 - DNA, 2208 bp, Adeno-associated virus 4
  misc_feature (750)..(750): n is a, c, t, or g
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataa

SEQ ID NO: 44 - DNA, 1872 bp, Adeno-associated virus 4
atgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataa

SEQ ID NO: 45 - DNA, 1611 bp, Adeno-associated virus 4
atgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacagattggctagaggacaacctctctga

SEQ ID NO: 46 - DNA, 1872 bp, Adeno-associated virus 4; identical to SEQ ID NO: 44

SEQ ID NO: 47 - DNA, 1617 bp, Adeno-associated virus 4
  misc_feature (162)..(162): n is a, c, t, or g
atgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 48 - DNA, 939 bp, Adeno-associated virus 4
atggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacagattggctagaggacaacctctctga

SEQ ID NO: 49 - DNA, 1197 bp, Adeno-associated virus 4
atggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaa

SEQ ID NO: 50 - DNA, 245 bp, Adeno-associated virus 4
ctccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagc

SEQ ID NO: 51 - protein, 313 aa, Adeno-associated virus 4
  MOD_RES (313)..(313): Xaa = any amino acid
MELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRLARGQPLX

SEQ ID NO: 52 - protein, 399 aa, Adeno-associated virus 4
MELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRYQNKCSRHVGMNLMLFPCRQCERMNQNVDICFTHGVMDCAECFPVSESQPVSVVRKRTYQKLCPIHHIMGRAPEVACSACELANVDLDDCDMEQ

SEQ ID NO: 53 - protein, 623 aa, Adeno-associated virus 4
MPGFYEIVLKVPSDLDEHLPGISDSFVSWVAEKEWELPPDSDMDLNLIEQAPLTVAEKLQREFLVEWRRVSKAPEALFFVQFEKGDSYFHLHILVETVGVKSMVVGRYVSQIKEKLVTRIYRGVEPQLPNWFAVTKTRNGAGGGNKVVDDCYIPNYLLPKTQPELQWAWTNMDQYISACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRYQNKCSRHVGMNLMLFPCRQCERMNQNVDICFTHGVMDCAECFPVSESQPVSVVRKRTYQKLCPIHHIMGRAPEVACSACELANVDLDDCDMEQ

SEQ ID NO: 54 - protein, 537 aa, Adeno-associated virus 4
  MOD_RES (537)..(537): Xaa = any amino acid
MPGFYEIVLKVPSDLDEHLPGISDSFVSWVAEKEWELPPDSDMDLNLIEQAPLTVAEKLQREFLVEWRRVSKAPEALFFVQFEKGDSYFHLHILVETVGVKSMVVGRYVSQIKEKLVTRIYRGVEPQLPNWFAVTKTRNGAGGGNKVVDDCYIPNYLLPKTQPELQWAWTNMDQYISACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRLARGQPLX

SEQ ID NO: 55 - protein, 623 aa, Adeno-associated virus 4; identical to SEQ ID NO: 53

SEQ ID NO: 56 - protein, 544 aa, Adeno-associated virus 4
MSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 57 - protein, 734 aa, Adeno-associated virus 4
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 58 - protein, 598 aa, Adeno-associated virus 4
TAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 59 - DNA, 129 bp, Adeno-associated virus 4
ttggccactccctctatgcgcgctcgctcactcactcggccctgcggccagaggccggcagtctggagacctttggtgtccagggcagggccgagtgagtgagcgagcgcgcatagagggagtggccaa

SEQ ID NO: 60 - DNA, 125 bp, Adeno-associated virus 4
ttggccactccctctatgcgcgctcgctcactcactcggccctggagaccaaaggtctccagactgccggcctctggccggcagggccgagtgagtgagcgagcgcgcatagagggagtggccaa

SEQ ID NO: 61 - DNA, 4768 bp, Adeno-associated virus 4
  misc_feature (3009)..(3009): n is a, c, t, or g
ttggccactccctctatgcgcgctcgctcactcactcggccctggagaccaaaggtctccagactgccggcctctggccggcagggccgagtgagtgagcgagcgcgcatagagggagtggccaactccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagccatgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataaatgactcaaaccagatatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacaccgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataacctgttaatcaataaaccggtttattcgtttcagttgaactttggtctccgtgtccttcttatcttatctcgtttccatggctactgcgtacataagcagcggcctgcggcgcttgcgcttcgcggtttacaactgccggttaatcagtaacttctggcaaaccatgatgatggagttggccactccctctatgcgcgctcgctcactcactcggccctggagaccaaaggtctccagactgccggcctctggccggcagggccgagtgagtgagcgagcgcgcatagagggagtggccaa

SEQ ID NO: 62 - DNA, 3098 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgctgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgaccgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcgaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtctctgcgaagggcgaattc

SEQ ID NO: 63 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGETGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 64 - DNA, 2495 bp, Adeno-associated virus
gaattcgccctttctacggctgcgtcaactagaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaccagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaacagtacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtctctgcgaagggcgaattc

SEQ ID NO: 65 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNTSNFAWTGATKYHLNGRNSLTNPGVAMATNKDDEDQFFPINGVLVFGKTGAANKTTLENVLMTSEEEIKTTNPVATEQYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 66 - DNA, 2504 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcatcacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccggctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagccggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 67 - protein, 731 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSSRDWQRLINNNWGFRPKRLNFKLFNIQVKEVTQNEGTKTIANNLTSTIQVFTDSEYRLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKPASFITQYSTGQVSVEIEWELQKENSKRWNPEIQYTSNYYKSTNVDFAVNTEGTYSEPRPIGTRYLTRNL

SEQ ID NO: 68 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctagggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggctaattcgtttcagttgaactttggtctctgcgaagggcgaattc

SEQ ID NO: 69 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 70 - DNA, 3084 bp, Adeno-associated virus
gaattcgccctttctacggctgcatcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagaaaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtccccggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctggtgaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctgtaattgcttgttaatcaataaaccggt

SEQ ID NO: 71 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILVKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 72 - DNA, 3123 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgctccagatgctgtttccctgcaaaacgtgcgagagaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtcctcggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctggtgaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctgtaattgcttgttaatcaataaaccggttaattcgtttcagttgaactttggtctctgcgaagggcgaattc

SEQ ID NO: 73 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILVKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 74 - DNA, 3122 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcgccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggagccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagactggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcacggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 75 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRLVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFTVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 76 - DNA, 3117 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggagccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcgggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagagcaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 77 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVRVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQSNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 78 - DNA, 3121 bp, Adeno-associated virus
gaattcgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggcgccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcctttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggacttggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgccgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 79 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDLEYQLPYVLGSAHQGCLPPFPADVFMVPQYGYLTLNNGSQALGRSSFYCLEYFPSQMPRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 80 - DNA, 3122 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagggttcttccgctgggcgcaggatcacgtgaccgaggtggcgcatgagttccacgtgcgagcccaagcgggcctgcccctcagtcgcggatccatcgacgtcagaccagaaagggtggagccaacaagagacccgcccccgatgacgcggatataagcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaattacatgttaatcaataaaccggttaattcgtttcagttgaactttggtctctgcgaagggcgaattc

SEQ ID NO: 81 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 82 - DNA, 2370 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagacgctgtttccctgcaaaacgtgcgagagaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtcctcggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtyggctcaggccaagaactggctacctggaccgtgttaccgtcagcaacgagtttccacgacactgtcgcaaaacaacaacagcaattttgctggaccggtgccacca

SEQ ID NO: 83 - protein, 738 aa, Artificial Sequence; identical to SEQ ID NO: 73
  Description of Artificial Sequence: Synthetic polypeptide

SEQ ID NO: 84 - DNA, 2205 bp, Adeno-associated virus
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 85 - protein, 734 aa, Adeno-associated virus; identical to SEQ ID NO: 57

SEQ ID NO: 86 - DNA, 3128 bp, Adeno-associated virus
gaattcgccctttctacggctgcgtcaactggaccaatgagaactttcccttcaacgattgcgtcgacaagatgttgatctggtgggaggagggcaagatgacggccaaggtcgtggagtccgccaaggccattctcggcggcagcaaagtgcgcgtggaccaaaagtgcaagccgtccgcccagatcgaccccacccccgtgatcgtcacctccaacaccaacatgtgcgccgtgattgacgggaacagcaccaccttcgagcaccagcagccgttgcgggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaaaaagacgtatcggaaactctgtgcgattcatcatctgctggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactgtaaatcccggtgtcgctatggcaacccacaaggacgacgaagagcgattttgcctggaccggtgccaccaagtatcatctgaatggcagagactctctgttttccgtccagcggagtcttaatgtttgggaaacagggagctggaaaagacaacgtggactatagcagcgttatgctaaccagtgaggaagaaattaaaaccaccaacccagtggccacggaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggacttcgctgttaacacagatggcacttattctgagcctcgccccattggcacccgttacctcacccgtaatctgtaattgctcgttaatcaataaaccggttgattcgtttcagttgaactttggtctctgcgaagggcgaattc

SEQ ID NO: 87 - protein, 738 aa, Artificial Sequence; identical to SEQ ID NO: 7
  Description of Artificial Sequence: Synthetic polypeptide

SEQ ID NO: 88 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaagtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggttgtcagaaaaaagacgtatcggaaactctgtgcgattcatcatctgctggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagacccaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccattggcacccgttacctcacccgtaatctgtaattgcttgttaatcaataaaccggttgattcgtttcagttgaactttggtctctgcgaagggcgaattc

SEQ ID NO: 89 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRPNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 90 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 91 - DNA, 2172 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctt

SEQ ID NO: 92 - protein, 720 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYL

SEQ ID NO: 93 - protein, 724 aa, Adeno-associated virus 5
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 94 - DNA, 2175 bp, Adeno-associated virus 5
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 95 - DNA, 2208 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctg

SEQ ID NO: 96 - protein, 736 aa, Adeno-associated virus 6
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 97 - protein, 623 aa, Adeno-associated virus 6
MPGFYEIVIKVPSDLDEHLPGISDSFVNWVAEKEWELPPDSDMDLNLIEQAPLTVAEKLQRDFLVQWRRVSKAPEALFFVQFEKGESYFHLHILVETTGVKSMVLGRFLSQIRDKLVQTIYRGIEPTLPNWFAVTKTRNGAGGGNKVVDECYIPNYLLPKTQPELQWAWTNMEEYISACLNLAERKRLVAHDLTHVSQTQEQNKENLNPNSDAPVIRSKTSARYMELVGWLVDRGITSEKQWIQEDQASYISFNAASNSRSQIKAALDNAGKIMALTKSAPDYLVGPAPPADIKTNRIYRILELNGYDPAYAGSVFLGWAQKRFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWAQDHVTEVAHEFYVRKGGANKRPAPDDADKSEPKRACPSVADPSTSDAEGAPVDFADRYQNKCSRHAGMLQMLFPCKTCERMNQNFNICFTHGTRDCSECFPGVSESQPVVRKRTYRKLCAIHHLLGRAPEIACSACDLVNVDLDDCVSEQ

SEQ ID NO: 98 - DNA, 4683 bp, Adeno-associated virus 6
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagcgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgacttcctggtccagtggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcgtgtttaaacctggccgagcgcaaacggctcgtggcgcacgacctgacccacgtcagccagacccaggagcagaacaaggagaatctgaaccccaattctgacgcgcctgtcatccggtcaaaaacctccgcacgctacatggagctggtcgggtggctggtggaccggggcatcacctccgagaagcagtggatccaggaggaccaggcctcgtacatctccttcaacgccgcctccaactcgcggtcccagatcaaggccgctctggacaatgccggcaagatcatggcgctgaccaaatccgcgcccgactacctggtaggccccgctccgcccgccgacattaaaaccaaccgcatttaccgcatcctggagctgaacggctacgaccctgcctacgccggctccgtctttctcggctgggcccagaaaaggttcggaaaacgcaacaccatctggctgtttgggccggccaccacgggcaagaccaacatcgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggatctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttaattcgtgtcagttgaactttggtctcatgtcgttattatcttatctggtcaccatagcaaccggttacacattaactgcttagttgcgcttcgcgaatacccctagtgatggagttgcccactccctctatgcgcgctcgctcgctcggtggggccggcagagcagagctctgccgtctgcggacctttggtccgcaggccccaccgagcgagcgagcgcgcatagagggagtgggcaa

SEQ ID NO: 99 - DNA, 2211 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 100 - protein, 736 aa, Adeno-associated virus; identical to SEQ ID NO: 96

SEQ ID NO: 101 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 102 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 103 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 104 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaa

SEQ ID NO: 105 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 106 - protein, 737 aa, Adeno-associated virus 7
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 107 - protein, 623 aa, Artificial Sequence
  Description of Artificial Sequence: Synthetic polypeptide
MPGFYEIVIKVPSDLDEHLPGISDSFVNWVAEKEWELPPDSDMDLNLIEQAPLTVAEKLQRDFLVQWRRVSKAPEALFFVQFEKGESYFHLHVLVETTGVKSMVLGRFLSQIREKLVQTIYRGVEPTLPNWFAVTKTRNGAGGGNKVVDECYIPNYLLPKTQPELQWAWTNMEEYISACLNLAERKRLVAQHLTHVSQTQEQNKENLNPNSDAPVIRSKTSARYMELVGWLVDRGITSEKQWIQEDQASYISFNAASNSRSQIKAALDNAGKIMALTKSAPDYLVGPSLPADIKTNRIYRILELNGYDPAYAGSVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWASDHVTEVAHEFYVRKGGASKRPAPDDADISEPKRACPSVADPSTSDAEGAPVDFADRYQNKCSRHAGMIQMLFPCKTCERMNQNFNICFTHGVRDCLECFPGVSESQPVVRKKTYRKLCAIHHLLGRAPEIACSACDLVNVDLDDCVSEQ

SEQ ID NO: 108 - DNA, 4721 bp, Adeno-associated virus 7
ttggccactccctctatgcgcgctcgctcgctcggtggggcctgcggaccaaaggtccgcagacggcagagctctgctctgccggccccaccgagcgagcgagcgcgcatagagggagtggccaactccatcactaggggtaccgcgaagcgcctcccacgctgccgcgtcagcgctgacgtaaatcacgtcataggggagtggtcctgtattagctgtcacgtgagtgcttttgcgacattttgcgacaccacgtggccatttgaggtatatatggccgagtgagcgagcaggatctccattttgaccgcgaaatttgaacgagcagcagccatgccgggtttctacgagatcgtgatcaaggtgccgagcgacctggacgagcacctgccgggcatttctgactcgtttgtgaactgggtggccgagaaggaatgggagctgcccccggattctgacatggatctgaatctgatcgagcaggcacccctgaccgtggccgagaagctgcagcgcgacttcctggtccaatggcgccgcgtgagtaaggccccggaggccctgttctttgttcagttcgagaagggcgagagctacttccaccttcacgttctggtggagaccacgggggtcaagtccatggtgctaggccgcttcctgagtcagattcgggagaagctggtccagaccatctaccgcggggtcgagcccacgctgcccaactggttcgcggtgaccaagacgcgtaatggcgccggcggggggaacaaggtggtggacgagtgctacatccccaactacctcctgcccaagacccagcccgagctgcagtgggcgtggactaacatggaggagtatataagcgcgtgtttgaacctggccgaacgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattaaaaccaaccgcatctaccgcatcctggagctgaacgggtacgatcctgcctacgccggctccgtctttctcggctgggcccagaaaaagttcgggaagcgcaacaccatctggctgtttgggcccgccaccaccggcaagaccaacattgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcacgactttggcaaggtgacgaagcaggaagtcaaagagttcttccgctgggccagtgatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgattcagatgctgtttccctgcaaaacgtgcgagagaatgaatcagaatttcaacatttgcttcacacacggggtcagagactgtttagagtgtttccccggcgtgtcagaatctcaaccggtcgtcagaaaaaagacgtatcggaaactctgcgcgattcatcatctgctggggcgggcgcccgagattgcttgctcggcctgcgacctggtcaacgtggacctggacgactgcgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaattgcatgttaatcaataaaccggttgattcgtttcagttgaactttggtctcctgtgcttcttatcttatcggtttccatagcaactggttacacattaactgcttgggtgcgcttcacgataagaacactgacgtcaccgcggtacccctagtgatggagttggccactccctctatgcgcgctcgctcgctcggtggggcctgcggaccaaaggtccgcagacggcagagctctgctctgccggccccaccgagcgagcgagcgcgcatagagggagtggccaa

SEQ ID NO: 109 - DNA, 2214 bp, Adeno-associated virus; identical to SEQ ID NO: 104

SEQ ID NO: 110 - protein, 737 aa, Adeno-associated virus; identical to SEQ ID NO: 106

SEQ ID NO: 111 - DNA, 2217 bp, Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 112 - DNA, 2213 bp, Adeno-associated virus 8
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgtaatacagaaggcgtgtactctgaaccccgccccattggcacccgttacctcacccgtaatctg

SEQ ID NO: 113 - DNA, 4393 bp, Adeno-associated virus 8
cagagagggagtggccaactccatcactaggggtagcgcgaagcgcctcccacgctgccgcgtcagcgctgacgtaaattacgtcataggggagtggtcctgtattagctgtcacgtgagtgcttttgcggcattttgcgacaccacgtggccatttgaggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggaaaagcttggtccagaccatctacccgcggggtcgagccccaccttgcccaactggttcgcggtgaccaaagacgcggtaatggcgccggcgggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctatatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattacccagaaccgcatctaccgcatcctcgctctcaacggctacgaccctgcctacgccggctccgtctttctcggctgggctcagaaaaagttcgggaaacgcaacaccatctggctgtttggacccgccaccaccggcaagaccaacattgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaattgcctgttaatcaataaaccggttgattcgtttcagttgaactttggtctctgcg

SEQ ID NO: 114 - protein, 738 aa, Adeno-associated virus 8; identical to SEQ ID NO: 105

SEQ ID NO: 115 - protein, 737 aa, Adeno-associated virus 8
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVIQKACTLNPAPLAPVTSPVI

SEQ ID NO: 116 - DNA, 2217 bp, Adeno-associated virus; identical to SEQ ID NO: 111

SEQ ID NO: 117 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcctgagcggacggcgatgagtcttccgggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctg

SEQ ID NO: 118 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLPERTAMSLPGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 119 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgagttttagtcgtgcggttctttgtgatggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctg

SEQ ID NO: 120 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLSFSRAVLCDGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 121 - DNA, 4385 bp, Adeno-associated virus 9
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacaccacatggccatttgaggtatatatggccgagtgagcgagcaggatctccattttgaccgcgaaatttgaacgagcagcagccatgccgggcttctacgagattgtgatcaaggtgccgagcgacctggacgagcacctgccgggcatttctgactcttttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggagaagctggtccagaccatctaccgcgggatcgagccgaccctgcccaactggttcgcggtgaccaagacgcgtaatggcgccggcggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtaggcccttcacttccggtggacattacgcagaaccgcatctaccgcatcctgcagctcaacggctacgaccctgcctacgccggctccgtctttctcggctgggcacaaaagaagttcgggaaacgcaacaccatctggctgtttgggccggccaccacgggaaagaccaacatcgcagaagccattgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccactcccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacggcaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccaaaggtgtttactctgagcctcgccccattggtactcgttacctcacccgtaatttgtaattgcctgttaatcaataaaccggttaattcgtttcagttgaactttggtctctgcg

SEQ ID NO: 122 - DNA, 4382 bp, Adeno-associated virus 9
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacaccacatggccatttgaggtatatatggccgagtgagcgagcaggatctccattttgaccgcgaaatttgaacgagcagcagccatgccgggcttctacgagattgtgatcaaggtgccgagcgacctggacgagcacctgccgggcatttctgactcttttgtgaactgggtggccgagaaggaatgggagctgcccccggattctgacatggatcggaatctgatcgagcaggcacccctgaccgtggccgagaagctgtagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggagaagctggtccagaccatctaccgcgggatcgagccgaccctgcccaactggttcgcggtgaccaagacgcgtaatggcgccggcggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtaggcccttcacttccggtggacattacgcagaaccgcatctaccgcatcctgcagctcaacggctacgaccctgcctacgccggctccgtctttctcggctgggcacaaaagaagttcgggaaacgcaacaccatctggctgtttgggccggccaccacgggaaagaccaacatcgcagaagccattgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccactcccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcaccccaagaaccagactcatcctcgggcatcggcaaatcaggccagcagcccgctaaaaagagactcaattttggtcagactggcgactcagagtcagtccccgacccacaacctctcggagaacctccagaagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccgaaggtgtttactctgagcctcgccccattggtactcgttacctcacccgtaatttgtaattgcctgttaatcaataaaccggttaattcgtttcagttgaactttggtctctgcg

SEQ ID NO: 123 - protein, 736 aa, Adeno-associated virus 9
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 124 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKSGQQPAKKRLNFGQTGDSESVPDPQPLGEPPEAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 125 - protein, 623 aa, Artificial Sequence
  Description of Artificial Sequence: Synthetic polypeptide
MPGFYEIVIKVPSDLDEHLPGISDSFVNWVAEKEWELPPDSDMDRNLIEQAPLTVAEKLQRDFLVQWRRVSKAPEALFFVQFEKGESYFHLHVLVETTGVKSMVLGRFLSQIREKLVQTIYRGIEPTLPNWFAVTKTRNGAGGGNKVVDECYIPNYLLPKTQPELQWAWTNMEEYISACLNLAERKRLVAQHLTHVSQTQEQNKENLNPNSDAPVIRSKTSARYMELVGWLVDRGITSEKQWIQEDQASYISFNAASNSRSQIKAALDNAGKIMALTKSAPDYLVGPSLPVDITQNRIYRILQLNGYDPAYAGSVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWASDHVTEVAHEFYVRKGGASKRPAPDDADKSEPKRACPSVADPSTSDAEGAPVDFADRYQNKCSRHAGMLQMLLPCKTCERMNQNFNICFTHGVRDCSECFPGVSESQPVVRKRTYRKLCAIHHLLGRAPEIACSACDLVNVDLDDCVSEQ

SEQ ID NO: 126 - DNA, 2211 bp, Adeno-associated virus
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 127 - protein, 736 aa, Adeno-associated virus; identical to SEQ ID NO: 123

SEQ ID NO: 128 - DNA, 2460 bp, Adeno-associated virus
ggtaattcctccggaaattggcattgcgattccacatggctgggcgaccgagtcattaccaccagcacccggacttgggccctgcccacctacaacaaccacctctacaagcaaatctccagccaatcgggtgccaccaacgacaaccactacttcggctacagcaccccttgggggtattttgatttcaacagattccactgccatttctcaccacgtgactggcagcgactcatcaacaacaactggggattcatggctgccgatggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttg

SEQ ID NO: 129 - DNA, 3123 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaggcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccaggccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcgcggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccagtggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccacctgacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataagccgatttatgcgtttcagttgaactttggtctctgcgaagggcgaattcgtttaaacct

SEQ ID NO: 130 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPGPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSAVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPVASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 131 - DNA, 3123 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcgggcaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagaaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcgaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacgataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcaggacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattcgcggccgcta

SEQ ID NO: 132 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGESGQQPAKKRLNFGQTGDTESVPDPQPIGEPPAAPSGVGSNTMASGGGAPMADDNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQDTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 133 - DNA, 3113 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgttcctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaataacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcaaccaagctgggcctagctccatggctcagcaggccaaaaactggctaccgggacccagctaccgacagcagcgaatgtctaagacggctaatgacaacaacaacagtgaatttgcttggactgcagccaccaaatattacccgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacgactaatcctgtggctacagaacaatacggacaggttgccaccaaccgtcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccggaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattc

SEQ ID NO: 134 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFNQAGPSSMAQQAKNWLPGPSYRQQRMSKTANDNNNSEFAWTAATKYYPNGRNSLVNPGPPMASHKDDEEKYFPMHGNLIFGKQGTGTTNVDIESVLITDEEEIRTTNPVATEQYGQVATNRQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 135 - DNA, 3122 bp, Adeno-associated virus
agcggccgcgaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaggtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcgcctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattc

SEQ ID NO: 136 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNRLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 137 - DNA, 3121 bp, Adeno-associated virus
gaattcgcccttcgcagagaccaaagttcaactgaaacgaatcaaccggtttattgattaacaagcaattacagattacgggtgaggtaacgggtgccgatggggcgaggctcagaataagtgccatctgtgttaacagcaaagtccacatttgtagatttgtagtagttggaagtgtattgaatctctgggttccagcgtttgctgttttctttctgcagctcccattcaatttccacgctgacctgtccggtgctgtactgcgtgatgaacgacgccagcttagcttgactgaaggtagttggaggatccgcgggaacaggtgtattcttaatcaggatctgaggaggcgggtgtttcagtccaaagccccccatcagcggcgagggatgaaagtttccgtccgtgtgaggaatcttggcccagataggaccctgcaggtacacgtcccggttctgccagaccatgccaggtaaggctccttgactgttgacggcccctacaataggagcggcgttttgctgttgcaggttatcggccaccacgccgtactgttctgtggccactgggttggtggttttaatttcttcctcactggttagcataacgctgctatagtccacgttgccttttccagctccctgtttcccaaacattaagactccgctggacggaaaaaatcgctcttcgtcgtccttgtgggttgccatagcgacaccgggatttaccagagagtctctgccattcagatgatacttggtggcaccggtccaggcaaagttgctgttgttattttgcgacagtgtcgtggagacgcgttgctgccggtagcagggcccgggtagccagtttttggcctgagccgacatgttattaggcccggcctgagaaaatagcaactgctgagttcctgcggtacctcccgtggactgagtccgagacaggtagtacaggtactggtcgatgagggggttcatcagccggtccaggctttggctgtgcgcgtagctgctgtgaaaaggcacgtcctcaaactggtagctgaactcaaagttgttgcccgttctcagcatttgagaaggaaagtactccaggcagtagaaggaggaacggcccacggcctgactgccattgttcagagtcaggtacccgtactgaggaatcatgaagacgtccgccgggaacggaggcaggcagccctggcgcgcagagccgaggacgtacgggagctggtattccgagtccgtaaagacctgaatcgtgctggtaaggttattggcgatggtcttggtgccttcattctgcgtgacctccttgacctggatgttgaagagcttgaagttgagtctcttgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgaagtcccgttggagatttgcttgtagaggtggttgttgtaggtggggagggcccaggttcgggtgctggtggtgatgactctgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctttcttgccgatgcccgtagtggagtctggagaacgctggggtgatggctctaccggtctcttctttccaggagccgtcttagcgccttcctcaaccagaccgagaggttcgagaacccgcttcttggcctggaagactgctcgtccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggcttcggggctccaggtttcagcgcccaccactcgcgaatgccctcagagaggttgtcctcgagccaatctggaagataaccatcggcagccatacctgatctaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaagggcgaattc

SEQ ID NO: 138 - protein, 733 aa, Artificial Sequence
  Description of Artificial Sequence: Synthetic polypeptide
MAADGYLPDWLEDNLSEGIREWWDLKPGAPKLKANQQKQDDGRGLVLPGYKYLGPFHGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEGEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRRNPEVQFTSNYGNQSSMLWAPDTTGKYTEPRVIGSRYLTNHL

SEQ ID NO: 139 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKIPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 140 - DNA, 3127 bp, Adeno-associated virus
gcggccgcgaattcgcccttcgcagagaccaaagttcaactgaaacgaatcaaccggtttattgattaacatgcaattacagattacgggtgaggtaacgagtgccaatagggcgaggctcagagtaaacaccctggctgtcaacggcaaagtccacaccagtctgcttttcaaagttggaggtgtactgaatctccgggtcccagcgcttgctgttttccttctgcagctcccactcgatttccacgctgacttgtccggtgctgtactgtgtgatgaacgaagcaaacttggcaggagtaaacacctccggaggattagcgggaacgggagtgttcttgatcaggatctgaggaggcggatgtttaagtccaaagccgcccatcaaaggagacgggtgaaagttgccatccgtgtgaggaatcttggcccagatgggaccctgcaggtacacgtcccggttctgccagaccatgccaggtaaggctccctggttgttgacaacttgtgtctgggctgcagtattagccgcttgtaagttgctgctgactatcccgtattcttccgtggctacaggattagtaggacgaatttcttcttcatttgtcattaacacattttccaatgtagttttgttagttgctccagtttttccaaaaatcaggactccgctggatgggaaaaagcggtcctcgtcgtccttgtgagttgccatggcgacgccgggattaaccaacgagtttctgccgttcaggtgatatttggtggcaccagtccaagcaaagttgctgttgttgttttgatccagcgttttggagaccctttgttgccggaagcagggtccaggtaaccaattcttggcttgttcggccatagttgaaggcccgccctggtaaaactgcagttcccgattgccagctgtgcctcctgggtcactctgtgttctggccaggtagtacaagtactggtcgatgaggggattcatcagccggtccaggctctggctgtgtgcgtagctgctgtggaaaggcacgtcctcgaagctgtagctgaactcaaagttgttgcccgttctcagcatctgagaggggaagtactccaggcagtagaaggaggaacgtcccacagactgactgccattgttgagagtcaggtagccgtactgaggaatcatgaagacgtccgccgggaacggaggcaggcagccctggtgcgcagagccgaggacgtacggcagctggtattccgagtccgagaatacctgaatcgtgctggtaaggttattagcgatggtcgtaacgccgtcattcgtcgtgacctccttgacctggatgttgaagagcttgaaccgcagcttcttgggccggaatccccagttgttgttgatgagtcgctgccagtcacgtggtgagaagtggcagtggaatctgttaaagtcaaaatacccccagggggtgctgtagccgaagtaggtgttgtcgttggtactacctgcagtttcactggagatttgctcgtagaggtggttgttgtaggtgggcagggcccaggttcgggtgctggtggtaatgactctgtcgcccagccatgtggaatcgcaatgccaatttcctgaggcattacccactccgtcggcaccttcgttattgtctgccattggtgcgccaccgcctgcagccactgtaccagatcccacactagagggcgctgctggaggttctccgagaggttgagggtcggggactgactctgagtcgccagtctgaccgaaattgagtctctttctggcgggctgctggcccttcttgccgatgcccgtggaggagtcgggggaacgctgaggtgacggctctaccggtctcttctttgcaggagccgtcttagcgccttcctcaaccagaccgagaggttcgagaacccgcttcttggcctggaagactgctcgcccgaggttgcccccaaatgacgtatcttcttgcagacgctcctgaaactcggcgtcggcgtggttataccgcaggtacgggttgtcacccgcattgagctgctggtcgtaggccttgtcgtgctcgagggccgctgcgtccgccgcgttgacgggctcccccttgtcgagtccgttgaagggtccgaggtacttgtagccaggaagcaccagaccccggccgttgtcctgcttttgctggttggctttgggtttcggggctccaggtttcaggtcccaccactcgcgaatgccctcagagaggttgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggtttagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtaatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcgatcacggcgcacatgttggtgttggagatgacgatcgcgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaaagggcgaattc

SEQ ID NO: 141 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLRPFNGLDKGEPVNEADAAALEHDKAYDKQLEQGDNPYLKYNHADAEFQERLQEDTSFGGNLGRAVFQAKKRVLEPLGLVEEVAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFSYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYVHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVCLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 142 - DNA, 3106 bp, Adeno-associated virus
gcggccgcgaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggcacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtctaggctctggctgtgcacatagctgctgtggaaaggcacttcctcaaaggtgtagctgaattcaaagttattgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagctgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccaggagccgtcttagcgacttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtctgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcactctctcgcatgtcttgcagggaaacagcatctgaagcatgcccgcgtgacgagaacatttgttttggtacctgtcggcaaagtccaccggagctccttccgcgtctgacgtcgatggattcgcgactgaggggcaggcccgcttgggctcgcttttatccgcgtcatcgggggcgggtctcttgttggccccaccctttctgacgtagaacccatgcgccacctcggtcacgtgatcctgcgcccagcggaagaaccttttgacttcctgctttgtcaccttgccaaagttatgctccagacggcgggtgggttcaaatttgaacatccggtcctgcaacggctgctggtgctcgaaggtggcgctgttcccgtcaatcacggcgcacatgttggtgttggaggtgacggtcacgggggtggggtcgatctgggcggacgacttgcacttttggtccacgcgcaccttgctgccgccgagaatggccttggcggactccacgaccttggccgtcatcttgccctcctcccaccagatcaccatcttgtcggcgcaatcgttgaagggaaagttctcattggtccagttgacgcagccgtagaaagggcgaattc

SEQ ID NO: 143 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTASGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFCCLEYFPSQMLRTGNNFEFSYTFEEVPFHSSYAHSQSLDRLMNPLIDQYLYYLARTQSTTGSTRELQFHQAGPNTVAEQSKNWLPGPCYRQQRLSKNIDSNNNSNFAWTGATKYHLNGRNSLTNPGVAMATNKDDEDQFLPINGVLVFGKTGAANKTTLENVLMTSEEEIKTTNPVATEEYGVVSSNLQSSTAGPRTQTVNSQGALPGMVWQNRDVYLQGPIWAEIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 144 - DNA, 3102 bp, Adeno-associated virus
gcggccgcgaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaatttcggcccagatgggaccctgcaggtacacgtcccggttctgccagaccatgccgggcagagccccctggctgttgacagtctgtgtccggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaggaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccacggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttattgcccgttctcagcatctgagaaggaaagtactccaggcagcagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccggaagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacatttgttttggtacctgtcggcaaagtccaccggagctccttccgcgtctgacgtcgatggatccgcgactgaggggcaagcccgcttgggctcgcttttatccgcgtcatcgggggcgggtctcttgttggctccaccctttctgacgtagaactcatgcgccacctcggtcacgtgatcctgcgcccagcggaagaactctttgacttcctgctttgtcaccttgccaaagtcatgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgaagggcgaattc

SEQ ID NO: 145 - protein, 728 aa, Adeno-associated virus
MAADGYLPDWLEDNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 146 - protein, 728 aa, Artificial Sequence
  Description of Artificial Sequence: Synthetic polypeptide
MAADGYLPDWLEGNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGDNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 147 - DNA, 3106 bp, Adeno-associated virus
gcggccgcgaattcgcccttcgcagagaccaaagttcaactgaaacgaatcagccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttatcgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggcggctggccgttcttgccgatgcccgtggaggagtcgggggattctatgggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacctgtagccaggaagcaccagaccccggccgtcgtcctgcttttgctggttggctttgggtttcggggctccaggtttcaagtcccaccactcgcgaatgccctcagagaggttgccctcgagccaatctggaagataaccatcggcagccatacctggtttaagtcatttattgctcagaaacacagtcatccaggtccacgttggccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcaggggaacagcatctgaagcatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggtctcttgttggctccaccctttctgacgtagaactcatacgccacctcggtcacgtgatcctgcgcccagcggaagaactctttgacttcctgctttgtcaccttgccaaagtcatgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcctgccctcctcccaccagatcaccatcttgtcgacgcaatcgttgaagggaaagttctcattggtccagttgacgcagccgtagaaagggcgaattc

SEQ ID NO: 148 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSMGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEGQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPGVFTPALFASFITQYSTGQVSVEIEWELQKENSKRWNPEIQYTSNYAKSNNVEFAVNNEGVYTEPRPIGTRYLTRNL

SEQ ID NO: 149 - DNA, 3098 bp, Adeno-associated virus
gaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaactaggcaggagtaaacacccctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggccctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttattgcccgttctcagcatctgagaaggaaagtactccaggcagtagaaggaggaacgtcccatagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcagcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggcctcttgttggctccaccctttctgacgtagaactcatgcgccacctcggtcacgtgatcctgcgcccagcggaagaactctttgacttcctgctttgtcaccttgccaaagtcctgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgtagaaagggcgaattc

SEQ ID NO: 150 - DNA, 2187 bp, Adeno-associated virus
atggctgccgatggttatcttccagattggctcgagggcaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 151 - protein, 728 aa, Adeno-associated virus; identical to SEQ ID NO: 146

SEQ ID NO: 152 - protein, 728 aa, Adeno-associated virus
MAADGYLPDWLEDNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGDNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 153 - protein, 728 aa, Adeno-associated virus; identical to SEQ ID NO: 145

SEQ ID NO: 154 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 155 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 156 - DNA, 2215 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcactctcctgtggagccagactcctcctcgggaaccggaaaggcgggccagcagcctgcaagaaaaagattgaattttggtcagactggagacgcagactcagtcccagaccctcaaccaatcggagaacctcccgcagccccctcaggtgtgggatctcttacaatggctgcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaagcaaatctccaacagcacatctggaggatcttcaaatgacaacgcctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatacgcagactctgggcttcagccaaggtgggcctaatacaatggccaatcaggcaaagaactggctgccaggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagtttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctccgcctcagatcctgatcaagaacacgcctgtacctgcggatcctccgaccaccttcaaccagtcaaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 157 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLKTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 158 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLKTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQQGNTQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 159 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQQGNTQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 160 - protein, 729 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLEHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 161 - DNA, 3075 bp, Adeno-associated virus
tgagaactttcctttcaacgattgcgtcggacaagatggtgatctggtgggaggaggggaagatgaccgccaaggtcgtggagtcggccaaagccattcttggaggaagcaaggtgcgtgtggaccagaaatgcaagtcctcggcccagatagacccgactcccgtgatcgtcacctccaacaccaacatgtgcgccgtgattgacgggaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcaacgtcagacgcggaagcttcgatcaactacgcggacaggtaccaaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaa

SEQ ID NO: 162 - DNA, 3142 bp, Adeno-associated virus
aaaacgacgggccagtgattgtaatacgactcactatagggcgaaattgaaattagcggccgcgaattcgcctttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagacttgttgtagttggaagtgtactgaatttcgggattccagcgtttgctgttctccttctgcagctcccactcgatctccacgctgacctgtcccgtggaatactgtgtgatgaaagaagcaaacttggcagaactgaagtttgtgggaggattggctggaacgggagtgtttttgatcatgatctgaggaggcgggtgtttgagtccaaaacctcccatcagtggagaaggatgaaagtgtccatcggtgtgaggaatcttggcccaaatgggtccctgcaggtacacgtctcgatcctgccacaccataccaggtaacgctccttggtgattgacagttccagtagttggaccagtgtttgagttttgcaaattatttgacacagtcccgtactgctccgtagccacgggattggtggccctgatttcttcttcatctgtaatcatgacattttccaaatccgcgtcgttggcatttgttccttgtttaccaaatatcagggttccatgcatggggaaaaacttttcttcgtcatccttgtgactggccatagctggtcctggattaaccaacgagtcccggccatttagatgatactttgtagctgcagtccagggaaagttgctgttgttgttgtcgtttgcctgttttgacagacgctgctgtctgtagcaaggtccaggcagccagtttttagcttgaagagacatgttggttggtccagcttggctaaacagtagccgagactgctgaagagttccactatttgtttgtgtcttgttcagataatacaggtactggtcgatcagaggattcatcagccgatccagactctggctgtgagcgtagctgctgtggaaaggcacgtcttcaaaagtgtagctgaactgaaagttgtttccagtacgcagcatctgagaaggaaagtactccaggcagtaaaaggaagagcgtcctaccgcctgactcccgttgttcagggtgaggtatccatactgtgggaccatgaagacgtccgctggaaacggcgggaggcatccttgatgcgccgagcccaggacgtacgggagctggtactccgagtcagtaaacacctgaaccgtgctggtaaggttattggcaatcgtcgtcgtaccgtcattctgcgtgacctctttgacttgaatattaaagagcttgaagttgagtcttttgggccggaatccccggttgttgttgacgagtctttgccagtcacgtggtgaaaagtggcagtggaatctgttgaagtcaaaatacccccagggggtgctgtagccaaagtagtggttgtcgttgctggctcctgattggctggagatttgcttgtagaggtggttgttgtatgtgggcagggcccaggttcgggtgctggtggtgatgactctgtcgcccagccattgggaatcgcaatgccaatttcctgaggaattacccactccatcggcaccctcgttattgtctgccattggtgcgccactgcctgtagccattgtagtagatcccagaccagagggggctgctggtggctgtccgagaggctgggggtcaggtacggagtctgcgtctccagtctgaccaaaatttaatctttttcttgcaggctgctggcccgcttttccggttcccgaggaggagtctggctccacaggagagtgctctaccggcctcttttttcccggagccgtcttaacaggctcctcaaccaggcccagaggttcaagaaccctctttttcgcctggaagactgctcgtccgaggttgcccccaaaagacgtatcttctttaaggcgctcctgaaactctgcgtcggcgtggttgtacttgaggtacgggttgtctccgctgtcgagctgccggtcgtaggccttgtcgtgctcgagggccgcggcgtctgcctcgttgaccggctcccccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcgcccgtttgggctcacttatatctgcgtcactgggggcgggtcttttcttagctccaccctttttgacgtagaattcatgctccacctcaaccacgtgatcctttgcccaccggaaaaagtctttcacttcctgcttggtgacctttccaaagtcatgatccagacggcgggtaagttcaaatttgaacatccggtcttgcaacggctgctggtgctcgaaggtcgttgagttcccgtcaatcacggcgcacatgttggtgttggaggtgacgatcacgggagtcgggtctatctgggccgaggacttgcatttctggtccacacgcaccttgcttcctccaagaatggctttggccgactccacgaccttggcggtcatcttcccctcctcccaccagatcaccatcttgtcgacgcaatggtaaaaggaaagttctcattgg

SEQ ID NO: 163 - protein, 735 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQDKALLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 164 - protein, 740 aa, Adeno-associated virus 2
MAADGYLPDWLEDTLSEGIRQWWKLKPGPPPPKPAERHKDDSRGLVLPGYKYLGPFNGLDKGEPVNAADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLLAAA

SEQ ID NO: 165 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATMYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYLTRN

SEQ ID NO: 166 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSEAKFASFITQYSTGQVSVEIEWELQKENSKRWNPEIQYTSNYNKSVNVDFTVDTNGVYSEPRPIGTRYLTRN

SEQ ID NO: 167 - protein, 739 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLLAA

SEQ ID NO: 168 - protein, 725 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRP

SEQ ID NO: 169 - protein, 707 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSCIYQPPERQQTSSYRRCQHTRRSSRHGLAGQRCVPSGAHLGKDSTHGRTFSPLSPHGWIRTTPSSTDSHQEHPGTCESFDHLQCGKVCFLHHTVLHGTGQRGDRVRAAEGKQQTLESRNSVHFQLQQVC

SEQ ID NO: 170 - protein, 739 aa, Adeno-associated virus 2; identical to SEQ ID NO: 167

SEQ ID NO: 171 - protein, 737 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHHPPQILIKNTPVPANPSTTFSAAKFASFITQYSTGQVSVEIEWELQKENSKRWNPEIQYTSNYNKSVNVDFTVDTNGVYSEPRPIGTRYLTRNLL

SEQ ID NO: 172 - protein, 741 aa, Adeno-associated virus 2
MAADGYLPDWLEDTLSEGIREWWALKPGAPKPKANQQKQDDGRGLVLPGYKYLGPFNGLDKGEPVNEADAAALEHDKAYDQQLQAGDNPYLRYNHADAEFQERLQEDTSFGGNLGRAVFQAKKRVLEPLGLVEEPVKTAPGKKRPVEHSPVEPDSSSGTGKSGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNLANHNNTTNARQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYL

SEQ ID NO: 173 - protein, 730 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTR

SEQ ID NO: 174 - protein, 735 aa, Adeno-associated virus 2
  MOD_RES (239)..(239): Xaa = any amino acid
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRXITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 175 - protein, 733 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFLAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLT

SEQ ID NO: 176 - protein, 734 aa, Adeno-associated virus 2
MAADGYLPDWLEDTLSEGIRQWWKLKPGPPPPKPAERHKDDSRGLVLPGCKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFSDSEYQLPYVLGSAHQGCLPPFPADVFMIPQYGYLTLNNGSQAVGRSSFYCLEYFPSQMLRTGNNFTFNYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 177 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALSTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYLTRN

SEQ ID NO: 178 - protein, 738 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDGGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLRP

SEQ ID NO: 179 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatggcggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacggcaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgacgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 180 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNGGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANGNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLTGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 181 - DNA, 2208 bp, Adeno-associated virus
atggctgccgatggttatcttccagattggctcgaggacactctctctgaaggaataagacagtggtggaagctcaaacctggcccaccaccaccaaagctcgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccatcagcctgcgagaaagagattgaattttggtcagactggagacgcagactccgtacctgacccccagcctctcggacagccaccagcagcccccacaagtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcacggtcccacagtatggatacctcaccctgaacaacgggagtcaggcggtaggacgctcttccttttactgcctggagtactttccttctcagatgctgcgtactggaaacaaccttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaactacagttctgccaagtttgcttctttcatcacacagtattccacgggccaggtcagcgtggagattgagtgggagctgcggaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 182 - protein, 735 aa, Adeno-associated virus
MAADGYLPDWLEDTLSEGIRQWWKLKPGPPPPKLAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFTVPQYGYLTLNNGSQAVGRSSFYCLEYFPSQMLRTGNNLTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNYSSAKFASFITQYSTGQVSVEIEWELRKENSKRWNPEIQYTSNYNKSVNVDFTVDTNGVYSEPRPIGTRYLTRNL

SEQ ID NO: 183 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcgtctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 184 - protein, 735 aa, Adeno-associated virus
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYRLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 185 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgcccttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatgggaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 186 - protein, 735 aa, Adeno-associated virus
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRPSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 187 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagaggccggtagagcactctcctgcggagccagactcctcctcgggaaccggaaaagcgggccagcagcctgcaagaaaaagattgaatttcggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgaacttgggccctgcccacctacaacaaccatctctacaagcaaatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggccagccacaaggacgatgaagaaaagttttttcctcagagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctgcagggcggcaacacacaagcagctaccgcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacagattctcatcaagaacaccccggtacctgcgaatccttcgaccaccttcagtgcggcaaagtttgcttctttcatcacacagtattccacggggcaggtcagcgtggagatcgagtgggagctgcagaaggagaacagcaaacgctggaatcccgagatccagtacacttccaactacaacaaatctgttaatgtggactttactgttgacactaatggcgtgtattcagagcctcgccccattggcaccagatacctgactcgtaatctgtaa

SEQ ID NO: 188 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 189 - DNA, 3161 bp, Adeno-associated virus
gattgaatttagcggccgcgaattcgcccttgctgcgtcaactggaccaatgagaactttccattcaatgattgcgtcgacaagatggtgatctggtgggaggagggaaagatgaccgccaaggtcatggagtcggccaaagccattctcggaggaagcaaggtgcgcgtggaccagaaatgtaagtcctcggcccagatagacccgactcccgtgattgtcacctccaacaccaacatgtgcgccgtgattgacgggaactcaacgaccttcgagcaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggcgcgcgggtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaggactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaaccctgcaggactagtccctttagtgagg

SEQ ID NO: 190 - DNA, 3162 bp, Adeno-associated virus
gaattgaatttagcggccgcgaattcgcccttcgcagagaccaaagttcaactgaaacgaattaaacggtttattgattaacaagcaattacagattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaagtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccgtactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagccgctgtggaaaggaacgtcctcaaaagtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtttgtagaggtggttgttgtaggtgggcagggcccaggttcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcctggagccgtcttgacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 191 - DNA, 3164 bp, Adeno-associated virus
gcgaattgaatttagcggccgcgaattcgcccttcgcagagaccaaagttcaactgaaacgaattaaacggtttattgattaacaagcaattacaaattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaggtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccatactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagctgctgtggaaaggaacgtcctcaaaagtgtagctgaaggtaaagttgtttccggtacgcagcatctgagaaggaaagtactccgggcagtaaaatgaagagcgtcctactgcctgactcccgttgctcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtctgtagaggtggttgttgtaggtgggcagggcccaggttcgggtgctggtggtgatgactctgtcgcccatccatgtggaatcgcaatgccgatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcccggagccgtcttaacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggcccacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 192 - DNA, 3163 bp, Adeno-associated virus
accctcactaaagggactagtcctgcaggtttaaacgaattcgcccttgctgcgtcaactggagcaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatggattctacgtcaaaaagggtggagccaagaaaagacccgcccctagtgacgcagatataagtgagcccaaacgggtgcgcgagtcagttgcgcagccatcgacgtcggacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgcgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtgctttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcgcc

SEQ ID NO: 193 - protein, 735 aa, Adeno-associated virus
MAADGYLPDWLEDTLSEGIRQWWKLKPGPPPPKPAERHKDDSRGLVLPGYKYLGPFNGLYKGEPVDEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDRQRLINNNWGFRPKRLNFKLFNIQVKEVTQNDGTTTIANNLTSTVQVFTDSGYQLPYVLGLAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKEDSKRWNPEIQYTSNYNKPVNVDFTVDTNGVYSEPRPIGTRYLTRNL

SEQ ID NO: 194 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactctacaagggagagccggtcgacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggccaaaaagagggttcttgaacctctgggcttggttggggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaataaccacctctacaagcaaatctccagccaatcaggagcctcaaacgacaaccactactttggctacagcaccccctgggggtattttgacttcaacagattccactgccacttttcaccacgtgaccggcaaagactcatcaacaacaactggggattccgaccaaaaagactcaacttcaagctctttaacattcaagtcaaagaggtcacgcagaatgacggtacgacgacgattgccaataaccttaccagcacggttcaggtgtttactgactcggggtaccagctcccgtacgtcctcggcttggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtggagatcgagtgggagctgcagaaggaggacagcaaacgctggaaccccgagatccagtacacttccaactataacaaacctgttaatgtggactttactgtggacactaatggtgtgtattcagagcctcgccccattggcaccagatacctgactcgtaatctgtaa

SEQ ID NO: 195 - DNA, 3161 bp, Adeno-associated virus
cgaattgatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactggatctcgggattccagcgtttgctgttctccttctgtagctcccactcgatctccacgctgacccgccccgtggaatactgtgtgatgaaggaagcaaactttgccgcactgaaggtggtcgaaggattcgcaggtaccggggtgtttttgatgagaatctgtggaggagggtgtttaagtccgaatccgcccatgaggggagaggggtgaaaatgtccgtccgtgtgcggaatctttgcccagataggcccctgcaggtacacgtctctgtcctgccagaccatgcctggaagaacgccttgtgtgttgacatctgcagtagatgcttgtgtgttgccgctctggaggttggtagatacagaaccatactgctccgtggccacgggattggtggttctgatttcctcttcgtctgtaatcatgaccttttcaatgtccacatttgttttctctgatccttgttttccaaagatgagaaccccgctctgaggaaaaaacttttcttcatcgtccttgtggctggccattgccgggcccggattcaccagagagtctctgccattgaggtggtacttggtagctccaatccacgagtattcactgttgttgttgtccgcagatgtctttgatactcgctgctggcggtaacagggtccaggaagccagttcctagactgatcccgaatgtcactcgctccggcctgagaaaactgaagcctggactgcgtggtggttccgcttggagtgtttgttctgctcaagtaatacaggtactggtcgatgagaggattcatgagacggtccaaactctggctgtgagcgtagctgctgtggaaaggaacatcctcaaaggtgtagctgaaggtaaagttgtttccggtacgcagcatctgagaagggaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccatcattctgcgtgacctctctgacttgaatgttaaagagcttgaagttgagtctcttgggccggaatccccagttgttgttgatgagtctttgccagtcacgtggtgaaaagtggcagtggaatctgttgaagtcaaaatacccccaaggggtgctgtagccaaagtagtggttgtcgttgctggctcctgattggctggaaatctgcttgtacagatggttgttgtaggtgggcagagcccaggttcgggtgctggtggtgatgactctgtcgcccatccatgtggaatcgcaatgccaatttcccgaggaattacccactccgtcggcgccatcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctggttgcccgcttttccggttcccgaggaggagtctggctccacaggagagtgctctaccggcctcttttttcccggagccgtcttaacaggctcctcaaccaggcccagaggttcaagaaccctcttttttgcctggaagactgctcgtccgaggttgcccccaaaagacgtatcttctttaaggcgctcctgaaactccgcgtcggcgtggtcgtacttgaggtacgggttgtctccgctgtcgagctgccggtcgtaggccttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaggcagtgcaagcgtctggcacctttcccatgatatgatgaatgtagcaaagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcgcccgtttgggctcacttatatctgcgtcactgggggcgggtcttttcttggctccaccctttttgacgtagaattcatgctccacctcaaccacgtgatcctttgcccaccggaaaaagtctttcacttcctgcttggtgaccttcccaaagtcatgatccagacggcgggttagttcaaatttgaacatccggtcttgcaacggctgctggtgttcgaaggtcgttgagttcccgtcaatcacggcgcacatgttggtgttggaggtggcgatcacgggagtcgggtctatctgggccgaggacttgcacttttggtccacgcgcaccttgcttcctccgagaatggcttcggccgattccacgaccttggcggtcatctttccctcctcccaccagatcaccatcttgtcgacacagtcgttgaagggaaagttctcattggtccagttgacgcagcaagggcgaattcgtttaaacctgcaggaactagtcccttagtgagg

SEQ ID NO: 196 - protein, 735 aa, Adeno-associated virus
MAADGYLPDWLEDTLSEGIRQWWKLKPGPPPPKPAERHKDDSRGLVLPGYKYLGPFNGLYKGEPVNEADAAALEHDKAYDRQLDSGDNPYLKYNHAGAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQDSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 197 - DNA, 2208 bp, Adeno-associated virus
atggctgccgatggttatcttccagattggctcgaggacactctctctgaaggaataagacagtggtggaagctcaaacctggcccaccaccgccaaagcccgcagagcggcataaggacgacagcaggggtcttgtgcttcctgggtacaagtacctcggacccttcaacggactctacaagggagagccggtcaacgaggcagacgccgcggccctcgagcacgacaaggcctacgaccggcagctcgacagcggagacaacccgtacctcaagtacaaccacgccggcgcggagtttcaggagcgccttaaagaagatacgtcttttgggggcaacctcggacgagcagtcttccaggccaaaaagagggttcttgaacctctgggcttggttgaggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgaccaaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaacccttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaagactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtagagatcgagtgggagctgcagaaggagaacagcaaacgctggaaccccgagatccagtacacttccaactataacaaatctgttaatgtggactttactgtggacactaatggtgtgtattcagagcctcgccccattggcaccagatacctgactcgtaatctgtaa

SEQ ID NO: 198 - protein, 738 aa, Adeno-associated virus
MAADGYLPDWLEDNLSEGIREWWDLKPGAPKPKANQQKQDDGRGLVLPGCKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYNKSVNVDFTVDTNGVYSEPRPIGTRYLTRNL

SEQ ID NO: 199 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctgcaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactataacaaatctgttaatgtggactttactgtggacactaatggtgtgtattcagagcctcgccccattggcaccagatacctgactcgtaatctgtaa

SEQ ID NO: 200 - DNA, 3167 bp, Adeno-associated virus
attgaatttagcggccgcgaattcgcccttcgcagagaccaaagttcaactgaaacgaattaaacggtttattgattaacaagcaattacagattacgagtcaggtacctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgatgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccggaatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcttgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctgctggcccgcttttccggttcccgaggaggagtctggctccgcaggagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttggggtacgggttgtctccgctgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagccgtagaaagggcgaattcgtttaaacctgcaggactagtccctttagtgagggt

SEQ ID NO: 201 - DNA, 3161 bp, Adeno-associated virus
aattgaatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgacgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccgggatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcctgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctccttcttgcaggctgctggcccgcttttccggttcccgaggaggagtctggctccgcaagagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttgaggtacgggttgtctccgccgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagcaagggcgaattcgtttaaacctgcaggactagtccctttagtgaggg

SEQ ID NO: 202 - DNA, 3172 bp, Adeno-associated virus
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcggaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccgcgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccgagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctgcgcacacagccagagctcggaccgactgatgaatcctctcatcgaccagtacctgtactacttatccagaactcggtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 203 - DNA, 3172 bp, Adeno-associated virus
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcggcgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcctccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 204 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgaaagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggagcctgttaaaacggctccgggaaaaaagaggccggtagagcactctcctgtggagccagactcctcctcgggaaccggaaaagcgggccagcagcctgcgagaaaaagattgaattttggtcagactggagacgcagactccgtacctgacccccagcctctcggacagccaccagcagccccctctggtctgggatctactacaatggcttcaggcagtggcgcaccagtggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacagctggggattccgacccaaaagactcaacttcaagctctttaacattcaagtcaaagaggtcacgcagaatgacggtacgacgacgattgccaataaccttaccagcacggttcaagtgtttaccgactcggagtaccagctcccgtacgtcctcggctcggcgcatcaaggatgcctcccgccgttcccagcagacgtctttatggtcccacagtatggatacctcaccctgaacaacgggagtcaggcggtaggacgctcttccttttactgcctggagtactttccttctcagatgctgcgtactggaaacaactttcagttcagctacacctttgaagacgttcccttccacagcagctacgctcacagccagagtctggatcggctgctgaatcctctgatcgaccagtacctatattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacacggacgggcactttcatccttctccactaatgggaggttttgggctcaaacacccgcctcctcagatcatgatcaaaaacactcccgttccagccaatcctcctacaaacttcagttcttccaagtttgcttctttcatcacacagtattccacggggcaggtcagcgtggagatcgagtgggagctgcagaaggagaacagcaaacgctggaatcccgaaattcagtatacttccaactacaacaaatctgttaatgtggactttactgtggacactaatggtgtgtattcagagcctcgccccattggcaccagatacccgactcgtaatctgtaa

SEQ ID NO: 205 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLESGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMASGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNSWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLLNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSSKFASFITQYSTGQVSVEIEWELQKENSKRWNPEIQYTSNYNKSVNVDFTVDTNGVYSEPRPIGTRYPTRNL

SEQ ID NO: 206 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggagaaaagaggccggtagagcactctcctgcggagccagactcctcctcgggaaccggaaaagcgggccagcagcctgcaagaaagagattgaattttggccagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggtattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcgtgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 207 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGEKRPVEHSPAEPDSSSGTGKAGQQPARKRLNFGQTGDADSVPDPQPLGQPPAAPSGLGTNTMASGSGAPMADNNEGADGVGNSSGNWYCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLVGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 208 - DNA, 2209 bp, Adeno-associated virus
atggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaat

SEQ ID NO: 209 - protein, 735 aa, Adeno-associated virus
MAADGYPPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQRPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNRQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 210 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaggtacctcggacccttcaacggactcgacaagggagagccggtcaacgaggcagacgccgcggccctcgagcacgacaaggcctacgaccggcagctcgacagcggagacaacccgtacctcaagtacaaccacgtcgacgcggagtttcaggagcgtcttaaagaagatacgtcttttgggggcaacctcggacgagcagtcttccaggccaaaaagaggattcttgaacctctgggcctggttgaggaacctgttaaggcggctccgggagaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggcattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctccccccatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcgccagatacctgactcgtaatctgtaa

SEQ ID NO: 211 - protein, 735 aa, Adeno-associated virus
MAADGYLPDWLEDTLSEGIRQWWKLKPGPPPPKPAERHKDDSRGLVLPGYRYLGPFNGLDKGEPVNEADAAALEHDKAYDRQLDSGDNPYLKYNHVDAEFQERLKEDTSFGGNLGRAVFQAKKRILEPLGLVEEPVKAAPGEKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGHFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPPMGGFGLKHPPPQILIKNTPVPANPSTTFSAAKFASFITQYSTGQVSVEIEWELQKENSKRWNPEIQYTSNYNKSVNVDFTVDTNGVYSEPRPIGARYLTRNL

SEQ ID NO: 212 - DNA, 2208 bp, Adeno-associated virus
atggctgccgatggttatcttccagattggctcgaggacaccctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagataacccgtacctcaagtacaaccacgccgacgcggagtttcaggagcgccttaaagaggatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccggcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 213 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPRPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 214 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaaggagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcggcagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagacgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 215 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKGDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGGRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQTLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 216 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctgcaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtattttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctacctacctccagagcggcaacacacaagcagctacctcagatgtcaacacacaaggcgttcttccaggcatggtctggcaggacagagacgtgtacctgcgggggcccatctgggcaaagattccacacacggacggacattttcacccctctcccctcatgggcggatttggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 217 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTCNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTYLQSGNTQAATSDVNTQGVLPGMVWQDRDVYLRGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 218 - DNA, 2208 bp, Adeno-associated virus; identical to SEQ ID NO: 212

SEQ ID NO: 219 - protein, 735 aa, Adeno-associated virus; identical to SEQ ID NO: 213

SEQ ID NO: 220 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacggcagcaggggtcttgtgcttcctgggtacaagtacctcggacccttcaacggactcgacaagggagagccggtcaacgaggcagacgccgcggccctcgagcacgacaaggcctacgaccggcagctcaacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagagaccggtagagcactctcctgcggagccagactcctcctcgggaaccggaaaagcgggccagcagcctgcaagaaagagattgaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccacaagcactcgaacctgggccctgcccacctacaacaaccacctctacaagcaaatctccagccaatcaggagcctcaaacgacaaccactattttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcggacgtcttcatggtcccacagtatggatacctcaccctgaacaacgggagtcaggcggtaggacgctctcccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggaccaccaatcccgtggctacggagcagtacgggactgtgtcaaataatttgcaaaactcaaacactggtccaactactggaactgtcaatcaccaaggagcgttacctggtatggtgtggcaggatcgagatgtgtaccttcagggacccatttgggccaagattcctcacaccgatggacactttcatccttctccactgatgggaggttttggactcaaacacccgcctcctcagattatgatcaaaaacactcccgttccagccaatcctcctacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacaataatggcgtgtactcagagcctcgccccattggcaccagatacctgactcgtaatctgtaa

SEQ ID NO: 221 - protein, 735 aa, Adeno-associated virus
MAADGYLPDWLEDTLSEGIRQWWKLKPGPPPPKPAERHKDGSRGLVLPGYKYLGPFNGLDKGEPVNEADAAALEHDKAYDRQLNSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSPFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDNNGVYSEPRPIGTRYLTRNL

SEQ ID NO: 222 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 223 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 224 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtatttcgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgccttccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacggccaaagtctggaccgtctcatgaatcctctcatcgaccagtacctgtattacttgagcagaacaaacactccaagcggaaccaccacgatgtccaggcttcagttttctcaggccggagcaagtgacgttcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcgtctttggaaaacaagactcgggaaaaactaatgtggacattgaaaaggttatgattacagacgaagaggaaatcaggaccaccaatcccgcggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgtttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 225 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSGYQLPYVLGSAHQGCLPPFPADVFMVPQYGYLTLNNGSQAVGRSSFYCLEYFPSQMLRTGNNFTFSYTFEDVPFHSSYAHGQSLDRLMNPLIDQYLYYLSRTNTPSGTTTMSRLQFSQAGASDVRDQSRNWLPGPCYRQQRVSKTAADNNNSDYSWTGATKYHLNGRDSLVNPGPAMASHKDDEEKYFPQSGVLVFGKQDSGKTNVDIEKVMITDEEEIRTTNPAATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFVSFITQYSTGQVSVEIEWELQKENSKRWNPEIQYTSNYNKSVNVDFTVDTNGVYSEPRPIGTRYLTRNL

SEQ ID NO: 226 - DNA, 2208 bp, Adeno-associated virus
atggctgccgatggttatcttccagattggctcgaggacactctctctgaaggaataagacagtggtggaaactcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttctggaacctctgagcctggttgaggagcctgttaagacggctccgggaaaaaagaggccggtagagcactctcccgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcaggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtcgggcaagacagagacgtgtacctgcaggggcctacttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 227 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLSLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIQDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVGQDRDVYLQGPTWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 228 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagggtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggcccagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 229 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLGYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 230 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 231 - protein, 735 aa, Adeno-associated virus; identical to SEQ ID NO: 230

SEQ ID NO: 232 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgcggcctggtttgaggaaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctggacgacagagtcatcgccaccagcacccgaacctgggccctgcccacatacaacaaccacctctacaagcaaatctccagccaatcaggagcctgcaacgacaaccactactttggctacagcaccccctgggggtattttgacttcaacagattccactgccacttttcaccacgtgactggcaaagactcatcaacagcaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcccgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcactgccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaataacaactgcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggcccaccaatcccgtggctacggagcagtacgggactgtgtcaaataatttgcaaaactcaaacactggtccaactacaggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaagcactcccgttccagccaatcctcccacaaacttcagttctgccaagtttgcttcttccatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 233 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLRPGLRKPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLDDRVIATSTRTWALPTYNNHLYKQISSQSGACNDNHYFGYSTPWGYFDFNRFHCHFSPRDWQRLINSNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFQFSYTFEDVPFHSSYAHCQSLDRLMNPLIDQYLYYLNKTQTNSGTLQQSRLLFSQAGPTNMSLQAKNWLPGPCYRQQRLSKQANDNNNCNFPWTAATKYHLNGRDSLVNPGPAMASHKDDEEKFFPMHGTLIFGKQGTNANDADLENVMITDEEEIRPTNPVATEQYGTVSNNLQNSNTGPTTGTVNHQGALPGMVWQDRDVYLQGPIWAKIPHTDGHFHPSPLMGGFGLKHPPPQIMIKSTPVPANPPTNFSSAKFASSITQYSTGQVSVEIEWELQKENSKRWNPEIQYTSNYNKSVNVDFTVDTNGVYSEPRPIGTRYLTRNL

SEQ ID NO: 234 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaggatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacagctttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttctttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 235 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNSFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 236 - DNA, 2211 bp, Adeno-associated virus; identical to SEQ ID NO: 126

SEQ ID NO: 237 - protein, 736 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGGQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVSTEGVYSEPRPIGTRYLTRNL

SEQ ID NO: 238 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggttcacagcccgctaaaaagaaactcaatttcggtcagactggcgacacagagtcagtccccgaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatgggagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagcgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctaatgggagggtttggaatgaagcacccgcctcctcagatcctcatcaaaaacacacctgtacctgcggatcctccaacggctttcaataaggacaagctgaactctttcatcacccagtattctactggccaagtcagcgtggagattgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 239 - protein, 736 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 240 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccggcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 241 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTGTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 242 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcctttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgagagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 243 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNESQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 244 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtaccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 245 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 246 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtactcgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagcaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtccgttaatgtggactttactgtggacactaatggcgtgtattcagagcctcgccccattggcaccagatacctgactcgtaatctgtaa

SEQ ID NO: 247 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAAGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 248 - protein, 738 aa, Adeno-associated virus; identical to SEQ ID NO: 90

SEQ ID NO: 249 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgttcggaaaacagggtgctggaagagacaatgtggactacagcagcgttatgctaaccagcgaagaagaaattaaaaccactaaccccgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 250 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNCHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 251 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGRTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYLDFNRFHCHFSPRDWQRLINNNWGFRPKRLSFKLFNIQVKEVTQNEGTKTIANNLASTIQVFTDSEYQPPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSRAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPTVGAVNSQGALPGMVWQNRDVYLQGPIWAKIPHTDGNFHPSPLMGGFGLKHPPPQILIKNTPVPADPPTAFNQAKLNSFIAQYSTGQVSVEIEWELQKENSKRWNPEIQYTSNYYKSTNADFAVNTEGVYSEPRPIGTRYLTRNL

SEQ ID NO: 252 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcggactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagttatcaccaccagcacccgaacctgggccctgcccacctacaacaaccacctctacaagcaaatctccaacgggacctcgggaggcagcaccaacgacaacacctactttggctacagcaccccctgggggtatcttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcgccagcaccatccaggtgtttacggactcggaataccagccgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcgggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctactgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcgcgcagtacagcaccggacaagtcagcgtggagatcgagtgggagctgcagaaggagaacagcaagcgctggaacccagagattcagtatacttccaactactacaaatctacaaatgcggactttgctgttaatactgagggtgtttactctgagcctcgccccattggcactcgttacctcacccgtaatctgtaa

SEQ ID NO: 253 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggagcctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcgtcaacaacaaccggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 254 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLVNNNRGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 255 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLSFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNSEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 256 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgagctttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattctgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 257 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGPVEEAAKTAPGKKRPVEPPPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTVANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 258 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtccggttgaggaagctgctaagacggctcctggaaagaagagaccggtagaaccgccacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccgtcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgttggaacccagagattcagtacacttcaaactactacaaatctacaaatgtggactttgctgtcaatacagagggaacttattctgagcctcgccccattggtactcgttacctcacccgtaatctgtaa

SEQ ID NO: 259 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQSNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGLGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 260 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagcggctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaagcaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggacttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 261 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTPFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIVQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 262 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 263 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacccgcggtataaccacgccgacgccgagtttcaggagcgtctgcaagaagatacgccttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctctccacagcagctacgcgcacagccagagcctggaccggctgatgaatcctctcatcgtccaatacctgtattacctgaacagaactcaaaatcagtccggaagtgcccaaaacaaggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccagcgttgattttactgtggacaacaatggactttatactgagcctcgccccattggcacccgttaccttacccgtcccctgtaa

SEQ ID NO: 264 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAETAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 265 - DNA, 2211 bp, Adeno-associated virus
atggctgccgatggttatcttccagattggctcgaggacactctctctgaaggaataagacagtggtggaagctcagacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagcgggttctcgaacctctcggtctggttgaggaaggcgctgagacggctcctggaaagaaacgtccggtagagcagtcgccacaagggccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacccgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaaggtagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 266 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 267 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 268 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 269 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgcctcccgccgttcccagcagacgtcttcatggtgccacagtatggataccccaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccgtggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 270 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSGYQLPYVLGSAHQGCLPPFPADVFMVPQYGYPTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAVASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 271 - DNA, 2211 bp, Adeno-associated virus
atggctgccgacggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgggcagtcttccaggccaagaagcgggttctcgaacctctcggtctggttgaggaaggcgctaagacggctcctggaaagaaacgtccggtagagcagtcgccacaagagccagactccccctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcactgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggccgcctccctccgttcccggcggacgtgttcatgattccgcaatacggctacctgacgctcaacaatggcagccaagccgtgggacgttcatcctcttactgcctggaatatttcccttctcagatgctgagaacgggcaacaactttaccttcagctacacctttgaggaagtgcctctccacagcagctgcgcgcacagccagagcctggaccggctgatgaatcctctcatcgaccaatacctgtattacctgaacagaactcaaaatcagtccggaagtgcccaaaacagggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccgcaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 272 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSPSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGRLPPFPADVFMIPQYGYLTLNNGSQAVGRSSSYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSAGQVSVEIEWELQKENSKRWNPEVQYTSNYAKSANVDFTVDNNGLYTEPRPIGTRYLTRPL

SEQ ID NO: 273 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 274 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacagtcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggctccagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 275 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDSHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 276 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 277 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 278 - DNA, 2211 bp, Adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggccagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtacttcaacgggggccagcaacgacaaccactacttcggctacggcaccccctgggggtattttgatttcaacagattccactgccacttttcaccacgtgactggcagcgactcatcaacaacaattggggattccggcccaagagactcaacttcaaactcttcaacatccaagtcgaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaacacaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcaccgctgtggcctcacacaaagacgacgaagacaagttctttcccatgagcggtgtcatgatttttggaaaagagagcgccggagcttcaagcactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 279 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 280 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 281 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGANSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 282 - DNA, 2208 bp, Adeno-associated virus
atggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaa

SEQ ID NO: 283 - protein, 735 aa, Adeno-associated virus
MAADGYLPDWLKDTLSEGIRQWWKLKPGPPPPKPAERHKDDSGGLVLPGYKYLGPFNGLDKGEPVNEADAAALEYDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGSWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVHLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 284 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcgcaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 285 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASRKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 286 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgtcaagacggctccaggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcggctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtacggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 287 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSGYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 288 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaatcggcattgcgattccacatggatgggcgacagagtcatcaccaccagcacccgaacctgggccctgcccacctacaacaaccacctctacagacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgagcaacgggagtcaggcagtaggacgctcttcattttactgcccggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacctaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatttgtaa

SEQ ID NO: 289 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNRHCDSTWMGDRVITTSTRTWALPTYNNHLYRQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLSNGSQAVGRSSFYCPEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGPKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 290 - DNA, 2205 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 291 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLRQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYYLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 292 - DNA, 3160 bp, Adeno-associated virus
acccttcactaaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcgggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaatcaatcg

SEQ ID NO: 293 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCRFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQGLDRLMNPLIDQYLYYLNRTQTASGTQQSRLLFSQAGPTSMSLQAKNWLPGPCYRQQRLSKQANDNNNSNFPWTGATKYHLNGGDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLRGPIWAKIPHADGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 294 - DNA, 3157 bp, Adeno-associated virus
ctcactaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccactctcggaggaagcaaggtgcgcgtggaccagaaacgcaagtcctcggcccagatagatccgactcccgtgatcgtcacctccaacaccaacatgtgcgccgtgattgacgggaactcaacgaccttcgaacaccagcagccgttgcaagaccgaatgttcaaatttgaactcacccgccgtctggatcatgacttcgggaaggtcaccaagcaggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggctctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccgcttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagggtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcggagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcggggacccatttgggccaagattcctcacgccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcg

SEQ ID NO: 295 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLECFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYHLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 296 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 297 - DNA, 3159 bp, Adeno-associated virus
gattgatttagcggccgcgaattcgcccttgctgcgtcaactggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtccatagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgagg

SEQ ID NO: 298 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPASPSGLGTNTMATGSGAPMADNNEGADGVGNSSGNWHCDSTWMGDRVVTTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 299 - DNA, 2205 bp, Adeno-associated virus
atggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 300 - DNA, 3156 bp, Adeno-associated virus
cgattgaatttagcggccgcgaattcgcccttgctgcgtcaacggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagcgaatgaatcagaattcaaatatctgcttcactcacggacagaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 301 - protein, 734 aa, Adeno-associated virus
MAADGYLPDWLEDTLSEGIRQWWKLKPGPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNEGADGVGNSSGDWHCDSTWMGDRVITTSTRTWALPTYNNHLYKQISSQSGASNDNHYFGYSTPWGYFDFNRFHCHFSPRDWQRLINNNWGFRPKRLNLKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNGEYSWTGATKYHLNGRDSLVNPGPAMASHKDDEEKFFPQSGVLIFGKQGSEKTNVDIEKVMITDEEEIRTTNPVATEQYGSVSTNLQSGNTRAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 302 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacgaccacgccgacgcggagtttcaggagcgccttaaagaagatacgtcttttgggggcaacctcggacgagcagtcttccaggcaaaaaagagggttcttgaacctctgggcctggttgaggagcctgttaagacggctccgggaaaaaagaggccggtagagcactctcctgtggagccagactcctcctcgggaaccggaaaagcgggcaaccagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgatggcgccgacggagtgggtaattcctcgggaaattggcattgcgattccacatggatgggcgacagagtcatcaccaccagcacccgaacctgggctctgcccacctacaacaaccatctgtacaagcagatttccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcagagaggtcacgcagaatgatggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtacttcccttctcagatgctgcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggatcagtctaggaactggcttcctggaccctgttaccgccagcagcgagtatcaaagacatctgcggacaacaacaacagtgaatactcgtggattggagctaccaagtaccacctcaatggcagagactctctggtgaatccgggcccggcaatggccagccacaaggacgatgaagaaaagttttttcctcagagcggggttctcatctttggaaaacaaggatcagagaaaacaaatgtggacattgaaaaggtcatgattacagacgaagaggaaatcagaaccaccaatcccgtggccacggagcagtatggttctgtatctaccaacctccagagcggcaacacacaagcatctactgcagatgtcaacacacaaggcgttcttccaggcatggtctggcaggacagagacgtgtacctgcaggggcctatctgggcaaagattccgcacacggacggacattttcacccctctcccctcatgggcggattcggacttaaacaccctcctccacagattctcatcaaaaacaccccggtacctgcgaatccttcgaccaccttcagtgcggcaaagtttgcttccttcatcacacagtattccacggggcgggtcagcgtggagatcgagtgggagctacagaaggagaacagcaaacgctggaatcccgagatccagtacacttccaactacaacaaatctgttaatgtggactttactgtggacactaatggtgtgtattcagagcctcgccccattggcaccagatacctgactcgtaatctgtaa

SEQ ID NO: 303 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYDHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNDGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVREVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWIGATKYHLNGRDSLVNPGPAMASHKDDEEKFFPQSGVLIFGKQGSEKTNVDIEKVMITDEEEIRTTNPVATEQYGSVSTNLQSGNTQASTADVNTQGVLPGMVWQDRDVYLQGPIWAKIPHTDGHFHPSPLMGGFGLKHPPPQILIKNTPVPANPSTTFSAAKFASFITQYSTGRVSVEIEWELQKENSKRWNPEIQYTSNYNKSVNVDFTVDTNGVYSEPRPIGTRYLTRNL

SEQ ID NO: 304 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccgcatggctgggcgacagagtcatcaccaccagcacccgaccctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 305 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSAWLGDRVITTSTRPWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 306 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLVDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 307 - DNA, 3158 bp, Adeno-associated virus
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgcggaccagaaatgcaagtcctcggcccagatagacccgactcccgtgattgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcgggcaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcactctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcaattcagctacacttttgaagacgtgcctttccacagcagctacgctcacagccagagtctggatcggctgatgaatcctctggtcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtga

SEQ ID NO: 308 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHPPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNRLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLVGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 309 - DNA, 3159 bp, Adeno-associated virus
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgtggaccagaaatgcaagtcctcggcccagatagacccgactcccgtgattgtcacctccaacaccgacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcaccctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaaccggctgcctggaccttgctacagacagcagcgtctgtcaaagcaggcaaacgacaacaacaacagcaactttccctggaccgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactggtgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 310 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacagcggagacaacccgtaccccaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaagcagatttccagccaatcaggagcctcaaacgacaaccactactttggctacagcaccccttgggggtattttgacttcaacagattccactgccacttttcgccacgtgactggcaaagactcatcaacaacaattggggattccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcatcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccaggtacctgactcgtaatctgtaa

SEQ ID NO: 311 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYPKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 312 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacggcggagacaacccgtacctcaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcttgcggagccagactcctcctcgggaaccggaaaagcgggccagcagcctgcaagaaggagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaggcagatttccagccaatcaggagcctcaaacgacaaccactactttggctacagcaccccttgggggtattttgacttcaacagattccactgccacttttcgccacgtgactggcaaagactcatcaacaacaattggggatcccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcgtcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccagatacctgactcgtaatctgtaa

SEQ ID NO: 313 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDGGDNPYLKYNHADAEFQERLKEDTSFGGNLGRAVFQAKKRVLEPLGLVEEPVKTAPGKKRPVEHSLAEPDSSSGTGKAGQQPARRRLNFGQTGDADSVPDPQPLGQPPAAPSGLGTNTMATGSGAPMADNNEGADGVGNSSGNWHCDSTWMGDRVITTSTRTWALPTYNNHLYRQISSQSGASNDNHYFGYSTPWGYFDFNRFHCHFSPRDWQRLINNNWGSRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLVDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 314 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSAGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTETIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSCAHSQSSDRLMNPLIDQYLYYLSRTRSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 315 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 316 - protein, 738 aa, Adeno-associated virus
MAADGYLPDWLEDNLSEGIREWWDLKPGAPKPKANQQKQDDGRGLVLLGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSGYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 317 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEPPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 318 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEGPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 319 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgagggacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtatcacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 320 - DNA, 2211 bp, Adeno-associated virus; identical to SEQ ID NO: 1

SEQ ID NO: 321 - DNA, 2208 bp, Adeno-associated virus
atggctgccgatggttatcttccagattggctcgaggacactctctctgaaggaacaagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 322 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccacctgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggagggagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaactgccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 323 - protein, 735 aa, Adeno-associated virus
MAADGYLPDWLEDTLSEGTRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 324 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacaacagcaggggtcttgtgcttcctgggtacaagtacctcggaccctccaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctgcagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtacccgctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtaccggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagccttgccccattggcaccagatacctgactcgtaatctgtaa

SEQ ID NO: 325 - protein, 735 aa, Adeno-associated virus
MAADGYLPDWLEDTLSEGIRQWWKLKPGPPPPKPAERHQDNSRGLVLPGYKYLGPSNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGCSTPWGYFDFNRFHCHFSPRDWQRLINNNWGFRPKRLNFKLFNIQVKEVTQNDGTTTIANNLTSTVQVFTDSEYPLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPCPIGTRYLTRNL

SEQ ID NO: 326 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 327 - protein, 737 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 328 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 329 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 330 - DNA, 2211 bp, Artificial Sequence
  Description of Artificial Sequence: Synthetic polynucleotide
atggctgctgacggttatcttccagattggctcgaggacaacctttctgaaggcattcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccccattggcacccgttaccttacccgtcccctgtaa

SEQ ID NO: 331 - protein, 736 aa, Artificial Sequence
  Description of Artificial Sequence: Synthetic polypeptide
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRPL

SEQ ID NO: 332 - DNA, 2211 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 333 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 334 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcccctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 335 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 336 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatgactgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 337 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 338 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgccttttcacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 339 - protein, 737 aa, Artificial Sequence; identical to SEQ ID NO: 327
  Description of Artificial Sequence: Synthetic polypeptide

SEQ ID NO: 340 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 341 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 342 - DNA, 2211 bp, Artificial Sequence
  Description of Artificial Sequence: Synthetic polynucleotide
atggctgccgatggttatcttccagattggctcgaggacaaccttagtgaaggaattcgcgagtggtgggcgctgaaacctggagccccgaagcccaaagccaaccagcaaaagcaggacgacggccggggtctggtgcttccgggttacaaatacctcggacccggtaacggactcgacaaaggagagccggtcaacgaggcggacgcggcagccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcccggaaagaaacgtccggtagagcagtcgccacaagagccagactcctctacgggcatcggcaagaaaggccaacagcccgccagaaaaagactcaatttcggtcagactggcgactcagagtcagttccagaccctcaacctctcggagaacctccagcagcgccctctggtgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaacacctacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 343 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPGNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSTGIGKKGQQPARKRLNFGQTGDSESVPDPQPLGEPPAAPSGVGPTTMASGGGAPMADNNEGADGVGNASGNWHCDSTWLGDRVITTSTRTWALPTYNNHLYKQISSASTGASNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 344 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 345 - protein, 734 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGLKHPPPQILIKNTPVPADPPTTFNQSKLNSFITQYSTGQVSVEIEWELQKENSKRWNPEVQYTSNYAKSANVDFTVDNNGLYTEPRPIGTRYLTRPL

SEQ ID NO: 346 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagtgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaggagagcgccggagcttcaaacactgcattggacaatgtcatgatcaccgacgaagaggaaatcaaagccactaaccccgtggccaccgaaagatttgggactgtggcagtcaatctccagagcagcagcacagaccctgcgaccggagatgtgcatgttatgggagccttacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 347 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKWVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 348 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctcggcgcaccagggctgcctccctccgttcccggcggacgtcttcatggtgccacagtatggatacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggacttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 349 - protein, 737 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMVPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGDLPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 350 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaactgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccagaccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatctgggccaagattcctcacacggacggcaacttccacccgtctccgctgatgggcggctttggcctgaaacatcctccgcctcagatcctgatcaagaacacgcctgttcctgcgaatcctccggcggagttttcagctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttaccaaacctctgtaa

SEQ ID NO: 351 - protein, 734 aa, Artificial Sequence
  Description of Artificial Sequence: Synthetic polypeptide
MAADGYLPDWLEDNLSEGIREWWALKPGVPQPKANQQHQDNCRGLVLPGYKYLGPGNGLDKGEPVNEADAAALEHDKAYDQQLKAGDNPYLKYNHADAEFQERLKEDTSFGGNLGRAVFQTKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTKPL

SEQ ID NO: 352 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 353 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 354 - DNA, 2214 bp, Artificial Sequence; identical to SEQ ID NO: 326
  Description of Artificial Sequence: Synthetic polynucleotide

SEQ ID NO: 355 - protein, 737 aa, Artificial Sequence; identical to SEQ ID NO: 327
  Description of Artificial Sequence: Synthetic polypeptide

SEQ ID NO: 356 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaaacacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 357 - protein, 734 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSTSVDFAVNTEGVYSEPRPIGTRYLTRNL

SEQ ID NO: 358 - DNA, 2217 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccctctcccctcatgggtggattcggacttaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 359 - protein, 738 aa, Artificial Sequence; identical to SEQ ID NO: 105
  Description of Artificial Sequence: Synthetic polypeptide

SEQ ID NO: 360 - DNA, 2211 bp, Artificial Sequence
  Description of Artificial Sequence: Synthetic polynucleotide
atggctgctgacggttatcttccagattggctcgaggacaacctttctgaaggcattcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaggtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccccattggcacccgttaccttacccgtcccctgtaa

SEQ ID NO: 361 - protein, 736 aa, Artificial Sequence; identical to SEQ ID NO: 331
  Description of Artificial Sequence: Synthetic polypeptide

SEQ ID NO: 362 - DNA, 2211 bp, Artificial Sequence; identical to SEQ ID NO: 330
  Description of Artificial Sequence: Synthetic polynucleotide

SEQ ID NO: 363 - protein, 736 aa, Artificial Sequence; identical to SEQ ID NO: 331
  Description of Artificial Sequence: Synthetic polypeptide

SEQ ID NO: 364 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 365 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 366 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcaacggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaaccgcttccactgccacttctcgccaagagactggcaaagactcatcaacaacaattggggattccggcccaagagactcaacttcaaactcttcaacatccaagtcaaggaggtcacgacgaatgatggcgtcacgaccatcgccaataacctcaccagcaccatccaggtgtttacggactcggagtaccagctgccgtacgttctcggctctgcccaccagggctgcctgcctccgttcccggcggacgtgttcatgattccccagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcagccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaggggcccatctgggcaaagattccacacacggacggacattttcacccctctcccctcatgggtggattcggacttaaacaccctcctccgcagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 367 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADATALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYYKSNNVEFAVNTEGVYSEPRPIGTRYLTRNL

SEQ ID NO: 368 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacctgggccctgcccacctacaacaaccacctctacaaacaaatttccagccaatcaggagcctcgaacgacaatcactactttggctacagcaccccttgggggtattttgatttcaacagattccactgccacttttcaccacgtgactggcagcgactcatcaacaacaattggggattccggcccaagagactcagcttcaagctcttcaacatccaggtcaaggaggtcacgcagaatgaaggcaccaagaccatcgccaataaccttaccagcacggttcaagtgtttacggactcggagtatcagctcccgtacgtgctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctgattgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggactatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccgtctccgctgatgggcggctttggcctgaaacatcctccgcctcagatcctgatcaagaacacgcctgtacctgcggatcctccgaccaccttcaaccagtcaaagctgaactctttcatcactcagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 369 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSQSGASNDNHYFGYSTPWGYFDFNRFHCHFSPRDWQRLINNNWGFRPKRLSFKLFNIQVKEVTQNEGTKTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDYEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 370 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgatttcaacagattccactgccatttctcaccacgtgactggcagcgactcatcaacaacaattggggattccggcccaagagactcaacttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatacgcagactctgggcttcagccaaggtgggcctaatacaatggccaatcaggcaaagaactggctgccaggaccctgttaccgccagcagcgagtatcaaagacatttgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctccgcctcagatcctgatcaagaacacgcctgtacccgcggatcctccgaccaccttcaaccagtcaaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 371 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPARKRLNFGQTGDADSVPDPQPLGQPPAAPSGLGTNTMATGSGAPMADNNEGADGVGNSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTFADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 372 - DNA, 2217 bp, Artificial Sequence
  Description of Artificial Sequence: Synthetic polynucleotide
atggctgccgatggttatcttccagattggctcgaggacactctctctgaaggaataagacagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaaccgcttccactgccacttctcgccaagagactggcaaagactcatcaacaacaattggggattccggcccaagagactcaacttcaaactcttcaacatccaagtcaaggaggtcacgacgaatgatggcgtcacgaccatcgccaataacctcaccagcaccatccaggtgtttacggactcggagtaccagctgccgtacgttctcggctctgcccaccagggctgcctgcctccgttcccggcggacgtgttcatgattccccagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcagccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaggggcccatctgggcaaagattccacacacggacggacattttcacccctctcccctcatgggtggattcggacttaaacaccctcctccgcagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 373 - protein, 738 aa, Artificial Sequence
  Description of Artificial Sequence: Synthetic polypeptide
MAADGYLPDWLEDTLSEGIRQWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYYKSNNVEFAVNTEGVYSEPRPIGTRYLTRNL

SEQ ID NO: 374 - DNA, 2208 bp, Artificial Sequence; identical to SEQ ID NO: 10
  Description of Artificial Sequence: Synthetic polynucleotide

SEQ ID NO: 375 - protein, 735 aa, Artificial Sequence [sequence omitted]

SEQ ID NO: 376 - DNA, 2208 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgccgcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaaaaagaggcttcttgaacctcttggtctggttgaggaagcagctaaaacggctcctggaaagaagaggcctgtagagcagtctcctcaggaaccggactcctccgcgggtattggcaaatcgggtgcacagcccgccaaaaagagactcaatttcggtcagactggcgactcagagtcagtcccagaccctcaacctctcggagaaccaccagcagcccccacaagtttgggatctaatacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacagcaaccatctctacaagcaaatctccagccaatcaggagcttcaaacgacaacgactactttggctacagcaccccttgggggtattttgatttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgaggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 377 - protein, 735 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRLLEPLGLVEEAAKTAPGKKRPVEQSPQEPDSSAGIGKSGAQPAKKRLNFGQTGDSESVPDPQPLGEPPAAPTSLGSNTMASGGGAPMADNNEGADGVGNASGNWHCDSTWLGDRVITTSTRTWALPTYSNHLYKQISSQSGASNDNDYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSEDNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 378 - DNA, 2208 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagttccaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtcccagaccctcaacctctcggagaaccaccagcagcccccacaagtttgggatctaatacaatggcttcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcttcaaacgacaaccactactttggctacagcaccccttgggggtattttgactttaacagattccactgccacttttcaccacgtgactggcagcgactcattaacaacaactggggattccggcccaagaaactcaacttcaagctctttaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtattacttgtctcggactcaaacaacaggaggcacgacaaatacgcagactctgggcttcagccaaggtgggcctaatacaatggccaatcaggcaaagaactggctgcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggttatgattacagacgaagaggaaatcaggacaaccaatcccgtggctacggagcagtatggttctgtatctaccaacctccagagaggcaacagacaagcagctaccgcagatgtcaacacacagggcgttcttccaggcatggtctggcaggacagagatgtgtaccttcagggtcccatttgggccaaaattcctcacacagatggacactttcacccgtcccctcttatgggcggctttggactcaagaacccgcctcctcagatcctcatcaaaaacacgcctgttcctgcgaatcctccggcagagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacactaatggcgtgtattcagagcctcgccccattggcaccagatacctcacccgtaatctgtaa

SEQ ID NO: 379 - protein, 735 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPAAPTSLGSNTMASGGGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKKLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDTNGVYSEPRPIGTRYLTRNL

SEQ ID NO: 380 - DNA, 2214 bp, Artificial Sequence; identical to SEQ ID NO: 370
  Description of Artificial Sequence: Synthetic polynucleotide

SEQ ID NO: 381 - protein, 737 aa, Artificial Sequence; identical to SEQ ID NO: 371
  Description of Artificial Sequence: Synthetic polypeptide

SEQ ID NO: 382 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggcagactggcgactcagagtcagtgcctgacccccaacctctctcagaaccacccgcaggtccctctggtctgggatctggtacaatggctgctggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactgggggttccggcccaagaagctcaacttcaagctcttcaacatccaggtcaaggaggtcacccagaatgaaggcaccaagaccatcgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgagccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggcgtggtggctgacaatctgcagcagaccaactcagctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 383 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGQTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVSPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 384 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccggcagcccgcgaaaaagagactgaattttgggcagactggcgactcagagtcagtgcctgacccccaacctctctcagaaccacccgcaggtccctctggtctgggatctggtacaatggctgcaggcggtggcgctccaatggcagacaataacgaaggcgccgacggagtgggtaatgcctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactggggattccggcccaagaggctcaacttcaagctcttcaacatccaggtcaaggaggtcacccagaatgaaggcaccaagaccatcgccaataacctcaccagcacggtgcaggtctttacggactcgaagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 385 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGRQPAKKRLNFGQTGDSESVPDPQPLSEPPAGPSGLGSGTMAAGGGAPMADNNEGADGVGNASGNWHCDSTWLGDRVITTSTRTWALPTYNNHLYKQISNGTSGGSSNDNTYFGYSTPWGYFDFNRFHCHFSPRDWQRLINNNWGFRPKRLNFKLFNIQVKEVTQNEGTKTIANNLTSTVQVFTDSKYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 386 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggccgactggcgactcagagtcagtgcctgacccccaacctctctcagaaccacctgcaggtccctctggtctgggatctggtacaatggctgcaggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgcgactggcagcgactcatcaacaacaactggggattccggcccaagaagctcaacttcaagctcttcaacatccaggtcaaggaggtcacccagaatgaaggcaccaagaccaccgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacggcagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagcgaaccccgccccattggcactcgttacctcacccgtaatctgtaa

SEQ ID NO: 387 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGPTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTTANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTAVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 388 - DNA, 4404 bp, Adeno-associated virus
atggctgccgatggttatcttccagattggctcgagggcaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaaatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaa

SEQ ID NO: 389 - protein, 738 aa, Adeno-associated virus; identical to SEQ ID NO: 7

SEQ ID NO: 390 - DNA, 3129 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaagtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaaaaagacgtatcggaaactctgtgcgattcatcatctgctgggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaattgcttgttaatcaataaaccggttgattcgtttcagttgaactttggtctctgcgaagggcgaattc

SEQ ID NO: 391 - protein, 738 aa, Artificial Sequence; identical to SEQ ID NO: 7
  Description of Artificial Sequence: Synthetic polypeptide

SEQ ID NO: 392 - protein, 733 aa, Artificial Sequence
  Description of Artificial Sequence: Synthetic polypeptide
MAADGYLPDWLEDNLSEGIREWWDLRPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTVSQNNNSNFAWTGATKYHLNGRDSLVNPGVAMATHKGDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 393 - DNA, 2501 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgagacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagagactcaactttgggcagactggcgactcagagtcagtgcccgaccctcaaccaatcggagaaccccccgcaggcccctctggtctgggatctggcacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtagactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttgattcgtttcagttgaactttggtctcaagggcgaattc

SEQ ID NO: 394 - DNA, 2187 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcgaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 395 - protein, 728 aa, Adeno-associated virus; identical to SEQ ID NO: 63

SEQ ID NO: 396 - protein, 728 aa, Adeno-associated virus; identical to SEQ ID NO: 155

SEQ ID NO: 397 - protein, 728 aa, Adeno-associated virus; identical to SEQ ID NO: 155

SEQ ID NO: 398 - protein, 733 aa, Artificial Sequence
  Description of Artificial Sequence: Synthetic polypeptide
MAADGHLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNSWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 399 - DNA, 3113 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaagacatgcgagagaatgaatcagaatttcagcatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggtcatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatagctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacagctggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 400 - protein, 731 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFRAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNRGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMAWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 401 - DNA, 3106 bp, Adeno-associated virus
gaattcgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggcgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcccgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccgggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaaccggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctaccagtttgaggacgtgccctttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggcctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 402 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 403 - DNA, 3197 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattcgtttaaacctgcaggactagtccctttagtgagggttaattctgagcttggcgtaatcatgggtcatag

SEQ ID NO: 404 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPRKLRFKLFNIQVKEVTTDDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMDGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 405 - DNA, 3276 bp, Adeno-associated virus
gaattcgcccttcgcagagaccaaagttcaactgaaacgaattaaccggtttattgattaacaggcaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgtccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctatgcgcatagctgctgtggaaaggcacttcctcaaaggtgtagctgaattcaaagttattgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgtccgtcgtgacctccttgacctggatgttgaacaacttgaaccgcagctttctgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgatgtcccgttggagatttgcttgtagaggtggttgttgtaggtggggagggcccaggttcgggtgctggtggtgatgactctgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctgtcttgccgatgcccgtagaggagtctggagaacgctggggtgatggctctaccggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacacttgttttggtacctgtcggcaaagtccaccggagctccttccgcgtctgacgtcgatggatgcaaaatgtcgcaaaagcactcacgtgacagctaatacaggaccactcccctatgacgtgatttacgtcagcgctatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggtctcttgttggctccaccctttctgacgtagaactcatgcgccacctcggtcacgtgatcctgcgcccagcggaagaactctttgacttcctgctttgtcaccttgccaaagtcatgctccagacggcgggtgagttcaaatttgaacatccggtcctgcaacggctgctggtgctcgaaggtggtgctgttcccgtcaatcacggcgcacatgttggtgttggaagtgacgatcacgggggtgggatcgatctgggcggaagacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgtagaaagggcgaattc

SEQ ID NO: 406 - protein, 738 aa, Adeno-associated virus; identical to SEQ ID NO: 71

SEQ ID NO: 407 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 408 - protein, 738 aa, Adeno-associated virus; identical to SEQ ID NO: 69

SEQ ID NO: 409 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGRKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 410 - DNA, 2489 bp, Adeno-associated virus
gaattcgccctttctacggctgcgtcaactggaccaatgagaactttcccttcaacgattgcgtcgacaagatggtgatctggtgggaggagggcaagatgacggccaaggtcgtgaagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaggaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgccaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtcaagggcgaattc

SEQ ID NO: 411 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRRQRLSKDIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 412 - DNA, 3098 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccggagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcggcagagactgtcaaaagacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagagaacagcaaacgctggaatccagagattcagtacacctcaaattatgccaagtctaataatgtggaatttgctgtcaacaacgaaggggtttatactgagcctcgccccattggcacccgttacctcacccgtaacctgtaattacttgttaatcaataaaccggttgattcgtttcagttgaactttggtctctgcgaagggcgaattc

SEQ ID NO: 413 - protein, 685 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLTNPLIDQYLYYLARTQSTTGSTRGLQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKYTSNYYKSTNVDFAVNTEGTYSEPRPIGTRYLTRNL

SEQ ID NO: 414 - DNA, 2969 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcatccgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgacgaaccccctcatcgaccagtacctgtactacctggcccggacccagagcactacggggtccacaagggggctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 415 - protein, 733 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTVSQNNNSNFAWTGATKYHLNGRDSLVNPGVAMATHKGDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRSL

SEQ ID NO: 416 - DNA, 3113 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtagcctgtaattgcctgttaatcaataaaccggttgattcgtttcagttgaactttggtctctgcgaagggcgaattc

SEQ ID NO: 417 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 418 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcgcgggaccagagactgttcagaatgtttcccgggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 419 - protein, 738 aa, Adeno-associated virus; identical to SEQ ID NO: 407

SEQ ID NO: 420 - DNA, 1933 bp, Adeno-associated virus
  misc_feature (1302)..(1302): n is a, c, t, or g
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatgnaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 421 - protein, 733 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLSPFPNDVFMVPQYGYCGIVTGENQNQTDRNAFYCLEYFPSQMLRTGNNFEMAYNFGKVPFHSMYAYSQSPDRLMNPLLDQYLWHLQSTTSGETLNQGNAATTFGKIRSGDFAFYRKNWLPGPCVKQQRLSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 422 - DNA, 3105 bp, Adeno-associated virus
gaattcgcccttgctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcccgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgtctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgggaaggtgccgttccactcaatgtatgcttacagccagagcccggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagactctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaagaagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgctggaatcctgaagtgcagtttacttcaaactatgggaaccagtcttctatgttgtgggctcccgatacaactgggaagtatacagagccgcgggttattggctctcgttatttgactaatcatttgtaactgcctagttaatcaataaaccgtgtgattcgtttcagttgaactttggtctctgcgaagggcgaattc

SEQ ID NO: 423 - protein, 733 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 424 - DNA, 3105 bp, Adeno-associated virus
gaattcgcccttgctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagctcaaggccaaccagcagaagcaggacgacggccggggtctggtgcttcctggctacaagtacctcggacccttccacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaaccactgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgcctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgagaaggtgccgttccactcaatgtatgctcacagccagagcctggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaaggagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgccggaatcctgaagtgcagtttacttcaaactatgggaaccagtcttctatgttgtgggctcccgatacaactgggaagtatacagagccgcgggttattggctctcgttatttgactaatcatttgtaactgcctagttaatcaataaaccgtgtgattcgtttcagttgaactttggtctctgcgaagggcgaattc

SEQ ID NO: 425 - protein, 733 aa, Artificial Sequence
  Description of Artificial Sequence: Synthetic polypeptide
MAADGYLPDWLEDNLSEGIREWWDLKPGAPKPKANQQKQDDGRGLVLPGYEYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFETAYNFEKVPFHSMYAHSQSLDGLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPAYPATTFTAARVDSFITQYSTGQVAVQIEWEIEKERSKRWNPEVQFTSNCGNQSSMLWAPDTTGKYTEPRVIGSRYLTNHL

SEQ ID NO: 426 - DNA, 3105 bp, Adeno-associated virus
gaattcgcccttcgcagagaccaaagttcaactgaaacgaatcacacggtttattgattaactaggcagttacaaatgattagtcaaataacgagagccaataacccgcggctctgtatacttcccagttgtatcgggagcccacaacatagaagactggttcccacagtttgaagtaaactgcacttcaggattccagcgtttggagcgttccttttcgatttcccattcaatctgaacagcgacctggccggtgctgtattgtgtgatgaaagagtccactctggctgcagtgaaggttgtcgcaggataggcaggtacgggggtgtttttgataaatatctggggaggcggatgtttcagtccaaaaccgccaattagcggtgaaggatgaaaatgtccgtccgcgtgtgggatcttggcccaaattggcccttggtagtaaatgtctctgttttgccacaccatgccaggaagcactcccatagcagtcacgttgccggttatgggagcagttgtagcattctgattattgtcagcaatctgaccaaacatgtccgtgtctcttgggttggtggcagcaatttcttcttctgatgtaaacaacagattgtttgctgaggttgttgtgtttccggtgactgatggtccagggaagatgagctgggcgttgctgaagtccccatctgaaggtccagctgttgccattggaggtccaggcgctatgttgctccagcggttgtttaaggtatagtgggtgtcatactttaacagagcgttgcccccgctggcaggaatcttgtaattttgactggcagtttttgagaatctctgctgtttaacacaaggcccaggcagccagttctttctgtaaaaggcaaagtctccactcctgatttttccaaatgtggttgctgcattgccttgattcagagtctctccagaggtggtcgactgtaagtgccacaggtactggtccaggaggggattcatcagtccgtccaggctctggctgtgagcatacattgagtggaacggcaccttctcaaagttgtaagccgtttcaaagttattgccagttctcagcatttgtgaaggaaaatactccaggcagtagaaagcatttctgtccgtctggttctgattttcgccagtcacaatgccacagtagccatattgaggcaccatgaagacgtcattggggaaaggaggcagacttccctcttgtccagcgtccatcacgtacgggagctcatacgacgagtccgcaaatatctgaaccgtgctggtaaggttattagcgaccgtagtctcgccgttcgacgttgtgacctccttaacttggatattgaagattttaacgcgcatggcttttggtcgtagtccccagttgttgttgatgagtctttgccagtcacgtggtgagaagtgacagtggaatctgttaaagtcaaagtatccccagggggtggagaatccgttgtaggtgttgctgtttgatgttgttccgagccgcaggtacaagtggttgttgtaggtgggcaagacccaggttctggtcgaggttgttgtgaccttgccctcagaccaggtggaatcgcaatgccaatcacccgaggcattacccactccatcggaaccttgtcccgcatcgacagcatttccgcccggtgctgcacgcatttcaatgtctgaagacatggcgctggtatctgatccttcagggggtccgtctccggctccagtgtcctcttcaaagttgagtctctttttggctggttgtttgccttttttgccgattcctgaggaggagtcgggctcttgtggtgactctaacggtctcttctttccaggagccgtcttagcaccttcttcaaccaggcccagaggttcgagtaccctcttcttggcctggaagactgctcgcccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtactcgtagccaggaagcaccagaccccggccgtcgtcctgcttctgctggttggccttgggcttgggggctccaggtttcaggtcccaccactcgcgaatgccctcagagaggttgtcctcgagccaatctggaagataaccgtcagcagccatacctggtttaagtcatttattgctcagaaacacagtcatccaagtccacgttgacgagatcgcaggccgaacacgcaatctcgggtgcccgccccagcagatgatgaatcgcgcacagtttctgatacgtcttttttctgacgacgggttgagattctgacgcgccggggaagcactctgagcagtctctgaccccgtgcgtgaagcagacgttgaaattctgattcattctctcgcatgtcttgcagggaaacagcatctgaagcatgcccgcgtgacgagaacatttgttttggtacctgtccgcaaggtccaccggtgcttccgcgtctgacgtcgatggctccgcaactgaggggcaggcccgcttgggctcgcttatatccgcgtcactgggggcgggtcttttggtggctccgccctttctgacgtagaactcatgcgccacctcagtcacgtgatcctgagcccagcggaagaactctttgacttcctgcttggtcaccttgccaaagtcgtgctccagacggcgggtgagctcgaacttgaacatgcggtcctgcagcggctgctggtgctcgaaggtggtgctgttcccgtcgatcacggcgcacatgttggtgttggaggtgacgatcacgggcgtggggtcgatctgggccgatgacttgcacttttggtccacgcgcaccttgcttccgcccagaatggccttggcggactccacgaccttggcggtcatcttgccctcctcccaccagatcaccatcttgtcgacgcaatcgttgaagggaaagttctcattggtccagttgacgcagcaagggcgaattc

SEQ ID NO: 427 - protein, 729 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQGLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQPSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLPRNL

SEQ ID NO: 428 - DNA, 3094 bp, Adeno-associated virus
gaattcgcccttgctgcgtcaactggaccaagagaactttcccttcaacgattgcgtcgacaagatggtgatctggtgggaggagggcaagatgacggccaaggtcgtggagtccgccaaagccattctgggcggaagcaaggtgcgcgtcgaccaaaagtgcaagtcctcggcccagatcgatcccacccccgtgatcgtcacctccaacaccaacatgtgcgccgtgatcgacgggaacagcaccaccttcgagcaccagcagccgttgcaggaccggatgttcaaatttgaactcacccgccgtctggaacacgactttggcaaggtgaccaagcaggaagtcaaagagttcttccgctgggctagtgatcacgtgactgaggtgacgcatgagttctacgtcagaaagggcggagccagcaaaagacccgcccccgatgacgcggatataagcgagcccaagcgggcctgtccctcagtcacggacccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacgcacggggtcagagactgtttagaatgtttccccggcgtgtcagaatctcaaccggtcgtcagaaaaaagacgtatcggaagctgtgtgcgattcatcatctgctggggcgggcacccgagattgcttgctcggcctgcgacctggtcaacgtggacctggacgactgtgtttctgagcaataaatgacttaaaccgggtatggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctggaaagaagagacccatagactctccagactcctccacgggcatcggcaaaaaaggccagcagcccgctaaaaagaagctcaattttggtcagactggcgactcagagtcagtccccgaccctcaacctcttggagaacctccagcagcgccctctagtgtgggatctggtacaatggctgcaggcggtggcgcaccaatggcagacaataacgaaggtgccgacggagtgggtaatgcctcaggaaattggcattgcgattccacatggctgggcgacagagtcatcaccaccagcaccagaacctgggccctccccacctacaacaaccacctctacaagcaaatctccagcagcagctcaggagccaccaatgacaaccactacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacaacgaatgacggcgtcacgaccatcgctaataaccttaccagcacggttcaggtcttctcggactcggaataccagctgccgtacgtcctcggctctgcgcaccagggctgcctgcctccgttcccggcggacgtcttcatgattcctcagtacggctacctgactctgaacaacggcagccaatcggtgggccgttcctccttctactgcctggaatatttcccctctcaaatgctgagaacgggcaacaactttgagttcagttacagcttcgaggacgtgcctttccacagcagctacgcgcacagccagagcctagaccggctgatgaaccctctcatcgaccagtacctgtactacctggcccggacccagagcaccacgggttccaccagggaactgcaatttcatcaagctgggcccaatactatggccgagcagtcaaagaactggctgcctggaccctgctataggcaacagggactgtcaaagaacttggactttaacaacaacagcaattttgcctggactgctgccactaaatatcatctgaatggcagaaactctttgaccaatcctggcattcccatggcaaccaacaaggatgatgaggaccagttctttcccatcaacggggtactggtttttggcaagacgggagctgccaacaaaactacgctggaaaacgttctgatgaccagcgaggaggagatcaagaccactaaccctgtggctacagaagaatacggtgtggtctccagcaacctgcagccgtctacagccgggcctcaatcacagactatcaacagccagggagcactgcctggcatggtctggcagaaccgggacgtgtatctgcagggtcccatctgggccaaaattcctcacacggatggcaactttcacccgtctcctctgatgggcggttttggactcaaacacccgcctccacagatcctgatcaaaaacacacctgtacctgctaatcctccggaggtgtttactcctgccaagtttgcctccttcatcacgcagtacagcaccggacaagtcagcgtggaaatcgagtgggagctgcagaaagaaaacagcaagcgctggaacccagaaattcagtatacttccaattatgccaagtctaataatgttgaatttgctgtgaaccctgatggtgtttatactgagcctcgccccattggcactcgttacctcccccgtaatctgtaattgcttgttaatcaataaaccggttgattcgtttcagttgaactttggtctctgcgaagggcgaattc

SEQ ID NO: 429 - protein, 1458 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLEHPPPQILIKNTPVPANPPEVFTPAKFASFITQYSTGQVSVEIEWELQKENSKRWNPEIQYTSNYAKSNNVEFAVNPDGVYTEPRPIGTRYLTRNLMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIGSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLLNIQVKEVTTNDGVTTIANNLTSTVQVFSDSEYQLPYVLGSAHQGCLPPFPADVFMIPQYGYLTLDNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 430 - DNA, 3095 bp, Adeno-associated virus
gaattcgcccttcgcagagaccaaagttcaactgaaacgaatcaaccggtttattgattaacaagcaattacagattacgggtgaggtaacgagtgccaatggggcgaggctcagtataaacaccatcagggttcacagcaaattcaacattattagacttggcataattggaagtatactgaatttctgggttccagcgcttgctgttttctttctgcagctcccactcgatttccacgctgacttgtccggtgctgtactgcgtgatgaaggaggcaaacttggcaggagtaaacacctccggaggattagcaggtacaggtgtgtttttgatcaggatctgtggaggcgggtgtttgagtccaaaaccgcccatcagaggagacgggtgaaagttgccatccgtgtgaggaattttggcccagatgggaccctgcagatacacgtcccggttctgccagaccatgccaggcagtgctccctggctgttgatagtctgtgattgaggcccggctgtagacgactgcaggttgctggagaccacaccgtattcttctgtagccacagggttagtggtcttgatctcctcctcgctggtcatcagaacgttttccagcgtagttttgttggcagctcccgtcttgccaaaaaccagtaccccgttgatgggaaagaactggtcctcatcatccttgttggttgccatgggaatgccaggattggtcaaagagtttctgccattcagatgatatttagtggcagcagtccaggcaaaattgctgttgttgttaaagtccaagttctttgacagtctctgttgcctatagcagggtccaggcagccagttctttgactgctcggccatagtattgggcccagcttgatgaaattgcagttccctggtggaacccgtggtgctctgggtccgggccaggtagtacaggtactggtcgatgagagggttcatcagccggtctaggctctggctgtgcgcgtagctgctgtggaaaggcacgtcctcgaagctgtaactgaactcaaagttgttgcccgttctcagcatttgagaggggaaatattccaggcagtagaaggaggaacggcccaccgattggctgccgttgtccagagtcaggtagccgtactgaggaatcatgaagacgtccgccgggaacggaggcaggcagccctggtgcgcagagccgaggacgtacggcagctggtattccgagtccgagaagacctgaaccgtgctggtaaggttattagcgatggtcgtgacgccgtcattcgttgtgacctccttgacctggatgttgaggagcttgaaccgcagcttcttgggccggaatccccagttgttgttgatgagtcgctgccagtcacgtggtgagaagtggcagtggaatctgttaaagtcaaaatacccccagggggtgctgtagccgaagtagtggttgtcattggtggctcctgagctgctgctggagatttgcttgtagaggtggttgttgtaggtggggagggcccaggttctggtgctggtggtgatgactctgtcgcccagccatgtggaatcgcaatgccaatttcctgaggcattacccactccgtcggcaccttcgttattgtctgccattggtgcgccaccgcctgcagccattgtaccagatcccacactagagggcgctgctggaggttctccaagaggttgagggtcggggactgactctgagtcgccagtctgaccaaaattgagcttctttttagcgggctgctggccttttttgccgatgcccgtggaggagtctggagagcctatgggtctcttctttccaggagccgtcttagcgccttcctcaaccagaccgagaggttcgagaacccgcttcttggcctggaagactgctcgcccgaggttgcccccaaatgacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggtttcggggctccaggtttcaggtcccaccactcgcgaatgccctcagagaggttgtcctcgagccaatctggaagataaccatcggcagccatacctggtttaagtcatttattgctcagaaacacagtcgtccaggtccacgttgaccaggtcgcaggccgagcaagcaatctcgggtgcccgccccagcagatgatgaatcgcacacagcttccgatacgtcttttttctgacgaccggttgagattctgacacgccggggaaacattctaaacagtctctgaccccgtgcgtgaagcaaatgttgaaattctgattcattctctcgcacgttttgcagggaaacagcacctgaagcatgcccgcgtgacgagaacatttgttttggtacctgtcggcaaagtccaccggagctccttccgcgtctgacgtcgatgggtccgtgactgagggacgggcccgcttgggctcgcttatatccgcgtcatcgggggcgggtcttttgctggctccgccctttctgacgtagaactcatgcgtcacctcagtcacgtgatcactagcccagcggaagaactctttgacttcctgctttgtcaccttgccaaagtcgtgttccagacggcgggtgagttcaaatttgaacatccggtcctgcaacggttgctggtgctcgaaggtggtgctgttcccgtcgatcacggcgcacatgttggtgttggaggtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagcaagggcgaattc

SEQ ID NO: 431 - DNA, 3095 bp, Adeno-associated virus
gaattcgcccttcgcagagaccaaagttcaactgaaacgaatcaaccggtttattgattaacaagcaattacagattacgggtgaggtaacgagtgccaatggggcgaggctcagtataaacaccatcagggttcacagcaaattcaacattattagacttggcataattggaagtatactgaatttctgggttccagcgcttgctgttttctttctgcagctcccactcgatttccacgctgacttgtccggtgctgtactgcgtgatgaaggaggcaaacttggcaggagtaaacacctccggaggattagcaggtacaggtgtgtttttgatcaggatctgtggaggcgggtgttcgagtccaaaaccgcccatcagaggagacgggtgaaagttgccatccgtgtgaggaattttggcccagatgggaccctgcagatacacgtcccggttctgccagaccatgccaggcagtgctccctggctgttgatagtctgtgattgaggcccggctgtagacgactgcaggttgctggagaccacaccgtattcttctgtagccacagggttagtggtcttgatctcctcctcgctggtcatcagaacgttttccagcgtagttttgttggcagctcccgtcttgccaaaaaccagtaccccgttgatgggaaagaactggtcctcatcatccttgttggttgccatgggaatgccaggattggtcaaagagtttctgccattcagatgatatttagtggcagcagtccaggcaaaattgctgttgttgttaaagtccaagttctttgacagtctctgttgcctatagcagggtccaggcagccagttctttgactgctcggccatagtattgggcccagcttgatgaaattgcagttccctggtggaacccgtggtgctctgggtccgggccaggtagtacaggtactggtcgatgagagggttcatcagccggtctaggctctggctgtgcgcgtagctgctgtggaaaggcacgtcctcgaagctgtaactgaactcaaagttgttgcccgttctcagcatttgagaggggaaatattccaggcagtagaaggaggaacggcccaccgattggctgccgttgttcagagtcaggtagccgtactgaggaatcatgaagacgtccgccgggaacggaggcaggcagccctggtgcgcagagccgaggacgtacggcagctggtattccgagtccgagaagacctgaaccgtgctggtaaggttattagcgatggtcgtgacgccgtcattcgttgtgacctccttgacctggatgttgaagagcttgaaccgcagcttcttgggccggaatccccagttgttgttgatgagtcgctgccagtcacgtggtgagaagtggcagtggaatctgttaaagtcaaaatacccccagggggtgctgtagccgaagtagtggttgtcattggtggctcctgagctgctgctggagatttgcttgtagaggtggttgttgtaggtggggagggcccaggttctggtgctggtggtgatgactctgtcgcccagccatgtggaatcgcaatgccaatttcctgaggcattacccactccgtcggcaccttcgttattgtctgccgttggtgcgccaccgcctgcagccattgtaccagatcccacactagagggcgctgctggaggttctccaagaggttgagggtcggggactgactctgagtcgccagtctgaccaaaattgagcttctttttagcgggctgctggccttttttgccgatgcccgtggaggagtctggagagtctatgggtctcttctttccaggagccgtcttagcgccttcctcaaccagaccgagaggttcgagaacccgcttcttggcctggaagactgctcgcccgaggttgcccccaaatgacgtatcttcttgcaggcgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggtttcggggctccaggtttcaggtcccaccactcgcgaatgccctcagagaggttgtcctcgagccaatctggaagataaccatcggcagccatacctggtttaagccatttattgctcagaaacacagtcgtccaggtccacgttgaccaggtcgcaggccgagcaggcaatctcgggtgcccgccccagcagatgatgaatcgcacacagcttccgatacgtcttttttctgacgaccggttgagattctgacacgccggggaaacattctaaacagtctctgaccccgtgcgtgaagcaaatgttgaaattctgattcattctctcgcacgttttgcagggaaacagcatctgaagcatgcccgcgtggcgagaacatttgttttggtacctgtcggcaaagtccaccggagctccttccgcgtctgacgtcgatgggtccgtgactgagggacaggcccgcttgggctcgcttatatccgcgtcatcgggggcgggtcttttgctggctccgccctttctgacgtagaactcatgcgtcacctcagtcacgtgatcactagcccagcggaagaactctttgacttcctgctttgtcaccttgccaaagtcgtgttccagacggcgggtgagttcaaatttgaacatccggtcctgcaacggctgctggtgctcgaaggtggtgctgttcccgtcgatcacggcgcgcatgttggtgttggaggtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagcaagggcgaattc

SEQ ID NO: 432 - protein, 729 aa, Adeno-associated virus; identical to SEQ ID NO: 160

SEQ ID NO: 433 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 434 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 435 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcggcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagcccttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgcactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgctacctcacccgtaatctgtaa

SEQ ID NO: 436 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQRPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKPFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLHYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 437 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgataacttgcagcaaaccaatacggggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 438 - protein, 738 aa, Adeno-associated virus; identical to SEQ ID NO: 90

SEQ ID NO: 439 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQDEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSARAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNSEGTYSEPRPIGTRYLTRNL

SEQ ID NO: 440 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcaggatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcgggctaagaactggctacctggaccttgctaccggcagcagcgagtctctacgacactgtcgcaaaacaacaacagcaactttgcttggactggtgccaccaaatatcacctgaacggaagagactctttggtaaatcccggtgttgctatggcaacgcataaggacgacgaggaacgtttctttccatcgagcggagtcctgatgtttggaaaacagggtgctggaagagacaatgtggactatagcagcgttatgctaaccagcgaggaagaaattaaaaccactaaccctgtagccacagaacaatacggtgtggtggctgacaacttgcagcaagccaatacagggcctattgtgggaaatgtcaacagccaaggagccttacctggcatggtctggcagaaccgagacgtgtacctgcagggtcccatctgggccaaaattcctcacacggacggcaattttcacccgtctcctctgatgggcggctttggactgaagcacccacctccccagatcctgatcaagaatacgccggtacctgcggatcctccaacgacgttcagccaggcaaaattggcttccttcatcacgcagtacagcaccggccaggtcagcgtggagatcgagtgggagctgcagaaggagaacagcaagcgatggaacccagaaattcagtacacttccaactactacaaatctacaaatgtggactttgctgtcaattctgagggtacatattcagagcctcgccccattggtactcgttatctgacacgtaatctgtaa

SEQ ID NO: 441 - DNA, 2211 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggcctggtgcttcctggctacaagtacctcggacccttcaacggactcgacaagggggagcccgtcaacgcggcggacgcagcggccctcgagcacgacaaggcctacgaccagcagctcgaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccagtagagcagtcaccccaagaaccagactcctcctcgggcatcggcaagaaaggccaacagcccgccagaaaaagactcaattttggccagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgttttttcccagtaacgggatcctgtttttggcaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctacagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 442 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLEAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPVTGSCFWQQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 443 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcagcgcggcggacgcagcggccctcgagcacgacaaggcctgcgaccagcggctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagggaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaatcacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacgaacagactggtgtggactttgccgttgacagccagggtgtttattctgagcctcgccccattggtactcgttacctcacccgtaatctgtaa

SEQ ID NO: 444 - protein, 737 aa, Adeno-associated virus
MAADGYLPDWLEDNLSEGIREWWDLKPGAPKPKANQQKQDDGRGLVLPGYKYLGPFNGLDKGEPVSAADAAALEHDKACDQRLKAGDNPYLRYNHADAEFQERLQEDTSFGGNLGRAVFQAKKRVLEPLGLVEEAAKTAPGKKGPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDEQTGVDFAVDSQGVYSEPRPIGTRYLTRNL

SEQ ID NO: 445 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcgactcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatccttatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgcttactctgagcctcgccccattggcactcgttacctcacccgtaatctgtaa

SEQ ID NO: 446 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSTQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGAYSEPRPIGTRYLTRNL

SEQ ID NO: 447 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaaggccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 448 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKATNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 449 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagcacctcggacccttcaacggactcgacaagggggagcccgtcaacgcggcggacgcagcggccctcgagcacgacaaggcctacgaccagcagctcaaagcgggtgacaatccgtacctgcggtataatcacgctgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 450 - protein, 738 aa, Adeno-associated virus
MAADGYLPDWLEDNLSEGIREWWDLKPGAPKPKANQQKQDDGRGLVLPGYKHLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 451 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 452 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 453 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 454 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 455 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacagcaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 456 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgcacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacttatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggagtaccagctgccgtacgtcctcggctctgcccaccagggctgcctgcctccgttcccggcggacgtcttcatgattcctcagtacggcaacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacatgggctatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacggcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 457 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPHLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQLIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGNLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNMGYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYGTGQVSVEIEWELQKENSKRWNPEIQYTSNYYKSTNVDFAVNTEGVYSEPRPIGTRYLTRNL

SEQ ID NO: 458 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccggaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcgtcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggagcccagagattcagtatacttccaactactacaaatctacaaatgtggactttgctgttaatactgagggtgtttactctgagcctcgccccattggcactcgttacctcacccgtaatctgtaa

SEQ ID NO: 459 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAGKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLVDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWSPEIQYTSNYYKSTNVDFAVNTEGVYSEPRPIGTRYLTRNL

SEQ ID NO: 460 - DNA, 2217 bp, Adeno-associated virus
atggttgccgatggttatcttccagattggctcgaggacaacctctctgagggcattcgcgagtggtgggacctgaaacctggagccccgaaacccaaagccaaccagcaaaagcagggcgacggccggggtctggtgcttcctggctacaagtacctcggacccttcaacggactcgacaagggggagcccgtcaacgcggcggacgcagcggccctcgagcacgacaaggcctacgaccagcagcttaaagcgggtgacaatccgtacctgcggtataatcacgccgacgccgagcttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgccagcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagccgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 461 - protein, 738 aa, Adeno-associated virus
MVADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAELQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCQPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWEPQKENSKRWNPEIQYTSNYYKSTNVDFAVNTEGVYSEPRPIGTRYLTRNL

SEQ ID NO: 462 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaatagcctcaccagcaccatccaggtgtttacggactcggaataccagctgccgtacgtcctcggctctgcccaccagggctgcctgcctccgttcccggcggacgtcttcatgattcctcagtacggctacctgactcccaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgtcttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacttgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 463 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANSLTSTIQVFTDSEYQLPYVLGSAHQGCLPPFPADVFMIPQYGYLTPNNGSQAVGRSSFYCLEYFPSQMLRTGNNFSFSYTFEDVPFHSSYAHSQSLDRLMNPLIDQYLYYLSRTQSTGGTAGTQQLLSSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 464 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYVHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNSGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYPTRNL

SEQ ID NO: 465 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgtgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaattcgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttaccccacccgtaatctgtaa

SEQ ID NO: 466 - protein, 734 aa, Adeno-associated virus; identical to SEQ ID NO: 291

SEQ ID NO: 467 - DNA, 2214 bp, Adeno-associated virus
atggctgctgacggttatcttccagattggctcgaggacaacctctctgagggcattcgcgagtggtgggacctgaaacctggagccccgaaacccaaagccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaacctctcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcgactcatcaacaacaactggggattccggcccaagaagctcaacttcaagctcttcaacatccaagtcaaggaggtcacgacgaatgacggcgtcacgaccatcgctaataaccttaccagcacggttcaggtcttttcggactcggagtaccagctgccgtacgtcctcggctctgcccaccagggctgcctgcctccgttcccggcggacgtcttcatgattcctcagtacggctacctgactctgaacaatggcagccaatcggtgggacgttcatccttctactgcctggaatacttcccttctcaggtgctgagaacgggtaacaacttcaccttcagttacaccttcgaggacgtgcctttccacagcagctacgcgcacagccagagcctagaccggctgatgaatcccctcatcgaccagtacctgtattacctggctagaacacagagtaacccaggaggcacatctggcaatcgggaactgcagttttaccagggcgggccttccaccatggccgaacaagccaagaactggttacctggaccttgcttccggcaacaaagagtttccaaaacactggatcaaaacaacaacagcaactttgcttggactggtgccaccaaatatcacctgaacggcagaaactcattggtgaatcctggtgtcgccatggcaactcacaaggacgacgaggaccgctttttcccatccagcggagtcctgatttttggaaaaactggagcaaccaacaagactacattggaaaacgtgttaatgacaaatgaagaagaaattcgtcctactaatcctgtggccacagaagaatacgggatagtcagcagcaatttacaagcggccaatactgcagcccagacacaagttgtcaacaaccagggagccttacctggcatggtctggcagaaccgggacgtgtacctgcagggtcccatctgggccaaaattcctcacacagacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 468 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPLGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQVLRTGNNFTFSYTFEDVPFHSSYAHSQSLDRLMNPLIDQYLYYLARTQSNPGGTSGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 469 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacacggctgggcgacagagtcatcaccaccagcacccggacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacgaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 470 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQRRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 471 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcttcaggaaattggcattgcgattcccaatggctgggcgacagagtcatcaccaccagcacccgaacctgggcccagcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggagctcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccgaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 472 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWAQPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGALQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHRGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 473 - DNA, 2217 bp, Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaacctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgcggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 474 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQTSNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSAEIEWELQKENSKRWNPEIQYTSNYYKSTNVDFAVNTEGVYSEPRPIGTRYLTRNL

SEQ ID NO: 475 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaacctccagcagcgccctctagtgtgggatctggtacaatggccgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagctgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaagcactcctgttcctgcggatcctccaacagcgttcaaccaggccaagctgaattctttcatcacgcagtacagcaccggacaagtcagcgtggagatcgagtgggagctgcagaaggagaacagcaagtgctggaacccagagattcagtatacttccaactactacaaatctacaaatgtggactttgctgttaatactgagggtgtttactctgagcctcgccccattggcactcgttacctcacccgtaatctgtaa

SEQ ID NO: 476 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKCWNPEIQYTSNYYKSTNVDFAVNTEGVYSEPRPIGTRYLTRNL

SEQ ID NO: 477 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 478 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccctaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 479 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNPTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 480 - DNA, 2208 bp, Adeno-associated virus
atggctgccgatggttatcttccagattggctcgaggacaacctctctgagggcattcacgagtggtgggacccgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacccacaacaaccacctctacaagcaaatctccaacgggacctcgggaggcagcaccaacgacaacgtctacttcggctacagcaccccctgggggtattttgacttcaacagattccactgtcacttctcaccacgtgaccggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacggaaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 481 - protein, 735 aa, Adeno-associated virus
MAADGYLPDWLEDNLSEGIHEWWDPKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTHNNHLYKQISNGTSGGSTNDNVYFGYSTPWGYFDFNRFHCHFSPRDRQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTEGTAGTQQLLFSQAGPSNMSAQARNWLPGPCYRQQRVSTTLSQNNNSNFAWTGATKYHLNGRDSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 482 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRPINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYPFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQDTAPIVGAVNSQGALPGMVWQNRDVYLQGPIWAKIPHTDGNFHPSPLMGGFGLKHPPPQVLIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 483 - DNA, 2217 bp, Adeno-associated virus
atggctgccgatggttatcttccagattggctcgaggacaacctctctgagggcattcgcgagtggtgggacctgaaacctggagccccgaaacccaaggccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgacccatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctaccctttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaagacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcaggtcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 484 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagttccaggagcgtctgcaagaagatacgtcttttgggggcaacctcgggcgagcagtcttccaggccaagaagcgggttctcgaacctctcggtctggctgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagagccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgggtgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatgacagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 485 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLAEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTGDGVTTIANNLTSTVQVFSDSEYQLPYVLGSAHQGCLPPFPADVFMIPQYGYLTLNNDSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 486 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgtgtgggagctgcagaaggagaacagcaagcgcaggaacccagagattcagtatacttccaactactacaaatctacaaatgtggactttgctgttaatactgagggtgtttactctgagcctcgccccattggcactcgttacctcacccgtaatctgtaa

SEQ ID NO: 487 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRRNPEIQYTSNYYKSTNVDFAVNTEGVYSEPRPIGTRYLTRNL

SEQ ID NO: 488 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 489 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRWNPEIQYTSNYYKSTNVDFAVNTEGVYSEPRPIGTRYLTRNL

SEQ ID NO: 490 - protein, 738 aa, Adeno-associated virus; identical to SEQ ID NO: 488

SEQ ID NO: 491 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctagaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 492 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPRPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 493 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccatgccgacgccgagtttcaggagcgtctgcaagaagatacgtcttttgggggcaacctcgggcgagcagtcctccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 494 - protein, 737 aa, Adeno-associated virus; identical to SEQ ID NO: 453

SEQ ID NO: 495 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVLQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 496 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccacccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggtgatcgagtgggagctgcagaaggagaacagcaagcgctggaacccagagattcagtatacttccaactactacaaatctacaaatgtggactttgctgttaatactgagggtgtttactctgagcttcgccccattggcactcgttacctcacccgtaatctgtaa

SEQ ID NO: 497 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPPSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVVIEWELQKENSKRWNPEIQYTSNYYKSTNVDFAVNTEGVYSELRPIGTRYLTRNL

SEQ ID NO: 498 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgccccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccatcagctacaccttcgaggacgttcccttccacagcagctacgcacacagccagagcctggaccggctgatgaatcctcttatcgaccagtacctgtattacctggccagaacacagagcaacgcaggaggcacagctggcaatcaggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 499 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTISYTFEDVPFHSSYAHSQSLDRLMNPLIDQYLYYLARTQSNAGGTAGNQELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 500 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccgcctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggatgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgagcggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattcttccatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatttgtaa

SEQ ID NO: 501 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPAYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLSGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSSITQYSTGQVSVEIEWELQKENSKRWNPEIQYTSNYYKSTNVDFAVNTEGVYSEPRPIGTRYLTRNL

SEQ ID NO: 502 - protein, 736 aa, Adeno-associated virus; identical to SEQ ID NO: 2

SEQ ID NO: 503 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 504 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQRQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 505 - protein, 736 aa, Adeno-associated virus
MAADGYLPDWLEDNLSEGIREWLNLKPGAPQPKANQQKQDNARGLVLPGYKYLGPFNGLDKGDPVNEADAAALEHDKAYGQQLKAGDNPYLKYNHADAEFQERLQKDTSFGGNLGKAVFQAKKRILEPLGLVETPAKTAPGKKRPVDPSPQRSPDSSSGIGKKSPHPARKRLNFGQTGEAESVPDPQPIGEPPSDPSSVGSGTMAAGGGAPMADNNEGADGVGNSSGNWHCDSTWLGDRVITTSTRTWALPTYNNHLYKQISSQSGATNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSKTQGTNATVQGAKLQFSQAGPSNMRDQARNWLPGPCYRQQRVSKTANDNNNSEYAWTGATKYHLNGRDSLVNPGPAMASHKDDEEKFFPMNGTLVFGKNGAGNSNVDIENVMITDEEEIRTTNPVATEQYGVVSDNLQSSNTRPITGDVDSQGVLPGMVWQDRDVYLQGPIWAKIPHTDGHFHPSPLMGGFGLKHPPPQILIKNTPVPANPATTFTPGKFASFITQYSTGQVSVQIEWELQKENSKRWNPEIQYTSNYNKSVNVDFTVDTNGVYSEPRPIGTRYLTRNL

SEQ ID NO: 506 - protein, 736 aa, Adeno-associated virus; identical to SEQ ID NO: 81

SEQ ID NO: 507 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 508 - protein, 736 aa, Artificial Sequence; identical to SEQ ID NO: 507
  Description of Artificial Sequence: Synthetic polypeptide

SEQ ID NO: 509 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQRANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 510 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDAFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 511 - DNA, 1803 bp, Bovine adeno-associated virus
acggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 512 - DNA, 1617 bp, Bovine adeno-associated virus
atgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 513 - DNA, 1173 bp, Bovine adeno-associated virus
atggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaa

SEQ ID NO: 514 - DNA, 1833 bp, Bovine adeno-associated virus
atggctaccttctatgaagtcattgttcgcgttccatttgatgtggaagagcacctgcctggaatttctgacaactttgtagactgggtaactggtcaaatttgggagctgcctcccgagtcagatttgaatttgactctgattgagcagcctcagctgacggtggctgacagaattcgccgcgtgttcctgtacgagtggaacaaattttccaagcaggagagcaaattctttgtgcagtttgaaaagggatctgaatattttcatctgcacacgctcgtggagacctccggcatctcttctatggtccttggccgctacgtgagtcagattcgcgcccagctggtgaaggtggtgttccagaacattgagccgcggattaacgactgggtcgccatcaccaaggtaaagaagggcggagccaataaggtggtggattctgggtatattcccgcctacctgctgccgaaggtccaaccagagcttcagtgggcgtggactaacctcgaagagtataaattggccgccctcaatctggaggagcgcaaacggctcgtcgctcagtttcagcttgagtcctcgcagcgctcgcaagaggcatcttcccagagggacgtttcggctgacccggtcatcaagagcaagacttcccagaaatacatggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaa

SEQ ID NO: 515 - DNA, 2211 bp, Bovine adeno-associated virus
atgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 516 - DNA, 4694 bp, Bovine adeno-associated virus
gtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgccacactctctagcaagggggttttgtaggtggtgatgtcattgttgatgtcattatagttgtcacgcgatagttaatgattaacagtcatgtgatgtgtgttatccaataggatgaaagcgcgcgaatgagatctcgcgagacttccggggtataaaaggggtgagtgaacgagcccgccgccattctctgctctggactgctagaggaccctcgctgccatggctaccttctatgaagtcattgttcgcgttccatttgatgtggaagagcacctgcctggaatttctgacaactttgtagactgggtaactggtcaaatttgggagctgcctcccgagtcagatttgaatttgactctgattgagcagcctcagctgacggtggctgacagaattcgccgcgtgttcctgtacgagtggaacaaattttccaagcaggagagcaaattctttgtgcagtttgaaaagggatctgaatattttcatctgcacacgctcgtggagacctccggcatctcttctatggtccttggccgctacgtgagtcagattcgcgcccagctggtgaaggtggtgttccagaacattgagccgcggattaacgactgggtcgccatcaccaaggtaaagaagggcggagccaataaggtggtggattctgggtatattcccgcctacctgctgccgaaggtccaaccagagcttcagtgggcgtggactaacctcgaagagtataaattggccgccctcaatctggaggagcgcaaacggctcgtcgctcagtttcagcttgagtcctcgcagcgctcgcaagaggcatcttcccagagggacgtttcggctgacccggtcatcaagagcaagacttcccagaaatacatggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaaataaagtgagtagtcatgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctagcccaattctgttgcataccctcaataaaccgtgtattcgtttcagtaaaatactgcctcttgtggtcattcggcgtacaacagcttacaacaacaacaaaacccccttgctagagagtgtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgccac

SEQ ID NO: 517 - protein, 390 aa, Bovine adeno-associated virus
MALVSWLVEHGITSEKQWIQENQESYLSFNSTGNSRSQIKAALDNASKIMSLTKSASDYLVGQTVPEDISENRIWQIFDLNGYDPAYAGSVLYGWCTRAFGKRNTVWLYGPATTGKTNIAEAISHTVPFYGCVNWTNENFPFNDCVEKMLIWWEEGKMTSKVVEPAKAILGGSRVRVDQKCKSSVQVDSTPVIITSNTNMCVVVDGNSTTFEHQQPLEDRMFRFELMRRLPPDFGKITKQEVKDFFAWAKVNQVPVTHEFMVPKKVAGTERAETSRKRPLDDVTNTNYKSPEKRARLSVVPETPRSSDVPVEPAPLRPLNWSSRYECRCDYHAKFDSVTGECDECEYLNRGKNGCIFHNATHCQICHAVPPWEKENVSDFNDFDDCNKEQ

SEQ ID NO: 518 - protein, 610 aa, Bovine adeno-associated virus
MATFYEVIVRVPFDVEEHLPGISDNFVDWVTGQIWELPPESDLNLTLIEQPQLTVADRIRRVFLYEWNKFSKQESKFFVQFEKGSEYFHLHTLVETSGISSMVLGRYVSQIRAQLVKVVFQNIEPRINDWVAITKVKKGGANKVVDSGYIPAYLLPKVQPELQWAWTNLEEYKLAALNLEERKRLVAQFQLESSQRSQEASSQRDVSADPVIKSKTSQKYMALVSWLVEHGITSEKQWIQENQESYLSFNSTGNSRSQIKAALDNASKIMSLTKSASDYLVGQTVPEDISENRIWQIFDLNGYDPAYAGSVLYGWCTRAFGKRNTVWLYGPATTGKTNIAEAISHTVPFYGCVNWTNENFPFNDCVEKMLIWWEEGKMTSKVVEPAKAILGGSRVRVDQKCKSSVQVDSTPVIITSNTNMCVVVDGNSTTFEHQQPLEDRMFRFELMRRLPPDFGKITKQEVKDFFAWAKVNQVPVTHEFMVPKKVAGTERAETSRKRPLDDVTNTNYKSPEKRARLSVVPETPRSSDVPVEPAPLRPLNWSSRYECRCDYHAKFDSVTGECDECEYLNRGKNGCIFHNATHCQICHAVPPWEKENVSDFNDFDDCNKEQ

SEQ ID NO: 519 - protein, 538 aa, Bovine adeno-associated virus
MRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 520 - protein, 736 aa, Artificial Sequence
  Description of Artificial Sequence: Synthetic polypeptide
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVHIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTNKNFSGYRKNWLPGPMMKQQRFSKTASQNYKIPQGGNNSLLHYETRTTLDRRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 521 - protein, 736 aa, Artificial Sequence
  Description of Artificial Sequence: Synthetic polypeptide
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 522 - protein, 736 aa, Bovine adeno-associated virus; identical to SEQ ID NO: 521

SEQ ID NO: 523 - protein, 600 aa, Bovine adeno-associated virus
TAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 524 - DNA, 2214 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctcctcgggcatcggcaagacaggccagcagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataaccttaccagcacggtccaggtcttcacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 525 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 526 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 527 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLQGDTSFGGNLGRAVFQAKKRVLEPLGLVEEGAKTAPGKKRPVEQSPQEPDSSSGIGETGQQPAKKRLNFGQTGDSESVPDPQPLGEPPATPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 528 - DNA, 2181 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcacaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgcacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactattggggcttcagaccccggtctctcagagtcaaaatcttcaacatccaagtcaaagaggtcacggtgcaggactccaccaccaccatcgccaacaacctcacctccaccgtccaagtgtttacggacgacgactaccaactcccgtacgtcgtcggcaacgggaccgagggatgcctgccggccttccccccgcaggtctttacgctgccgcagtacggctacgcgacgctgaaccgagacaacggagacaacccgacagagcggagcagcttcttttgcctagagtactttcccagcaagatgctgaggacgggcaacaactttgagtttacctacagctttgaagaggtgcccttccactgcagcttcgccccgagccagaacctctttaagctggccaacccgctggtggaccagtacctgtaccgcttcgtgagcacctcggccacgggcgccatccagttccaaaagaacctggcgggcagatacgccaacacctacaaaaactggttcccggggcccatgggccgaacccagggctggaacacgagctctggggtcagcagcaccaacagagtcagcgtcaacaacttttccgtctcaaaccggatgaacctggagggggccagctaccaagtgaacccccagcccaacgggatgacaaacacgctccaaggcagcaaccgctacgcgctggaaaacaccatgatcttcaacgctcaaaacgccacgccgggaactacctcggtgtacccagaggacaatctactgctgaccagcgagagcgagactcagcccgtcaaccgggtggcttacaacacgggcggtcagatggccaccaacgcccagaacgccaccacggctcccacggtcgggacctacaacctccaggaagtgcttcctggcagcgtatggatggagagggacgtgtacctccaaggacccatctgggccaagatcccagagacgggggcgcactttcacccctctccggccatgggcggattcggactcaaacacccgccgcccatgatgctcatcaaaaacacgccggtgcccggcaacatcaccagcttctcggacgtgcccgtcagcagcttcatcacccagtacagcaccgggcaggtcaccgtggagatggaatgggagctcaaaaaggaaaactccaagaggtggaacccagagatccagtacaccaacaactacaacgacccccagtttgtggactttgctccagacggctccggcgaatacagaaccaccagagccatcggaacccgatacctcacccgacccctt

SEQ ID NO: 529 - protein, 726 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNGDNPTERSSFFCLEYFPSKMLRTGNNFEFTYSFEEVPFHCSFAPSQNLFKLANPLVDQYLYRFVSTSATGAIQFQKNLAGRYANTYKNWFPGPMGRTQGWNTSSGSSTNRVSVNNFSVSNRMNLEGASYQVNPQPNGMTNTLQGSNRYALENTMIFNAQNATPGTTSVYPEDNLLLTSESETQPVNRVAYNTGGQMATNAQNATTAPTVGTYNLQEVLPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDGSGEYRTTRAIGTRYLTRPL

SEQ ID NO: 530 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKSGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 531 - DNA, 1797 bp, Artificial Sequence
  Description of Artificial Sequence: Synthetic polynucleotide
acggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 532 - DNA, 1989 bp, Artificial Sequence
  Description of Artificial Sequence: Synthetic polynucleotide
atgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataa

SEQ ID NO: 533 - DNA, 1626 bp, Artificial Sequence
  Description of Artificial Sequence: Synthetic polynucleotide
atgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccagattggttggagcggttggtcaaaaagggagtgaatgctgcagctga

SEQ ID NO: 534 - DNA, 1323 bp, Artificial Sequence
  Description of Artificial Sequence: Synthetic polynucleotide
atggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataa

SEQ ID NO: 535 - DNA, 960 bp, Artificial Sequence
  Description of Artificial Sequence: Synthetic polynucleotide
atggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccagattggttggagcggttggtcaaaaagggagtgaatgctgcagctga

SEQ ID NO: 536 - DNA, 1608 bp, Artificial Sequence
  Description of Artificial Sequence: Synthetic polynucleotide
atggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 537 - DNA, 2232 bp, Artificial Sequence
  Description of Artificial Sequence: Synthetic polynucleotide
atgtctctcatttctgatgcgattccagattggttggagcggttggtcaaaaagggagtgaatgctgcagctgatttctaccatttggaaagcggtcctcctcgtcctaaggcaaatcagcaaactcaagaatctcttgaaaaggacgattcgagaggtctcgtgttcccaggctacaattatctaggccctttcaacggtctagataaaggagaacccgtcaacgaggcagacgctgccgccttagaacacgacaaggcttacgacctcgaaatcaaggacgggcacaacccgtactttgagtacaacgaggccgacagacgtttccaggaacgtctcaaagacgatacctcctttggaggcaatttaggtaaagccatcttccaggccaaaaagagggttctcgaaccctttggtctggtggaagactcaaagacggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 538 - protein, 535 aa, Artificial Sequence
  Description of Artificial Sequence: Synthetic polypeptide
MAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 539 - protein, 440 aa, Artificial Sequence
  Description of Artificial Sequence: Synthetic polypeptide
MELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRYRIKCSKHCGMDKMLFPCQICESMNRDINICAIHKTTDCKECFPDYGDKDDVELPPCTEHNVSRCYQCHSGELYRVTSDSDEKPAPESDEGTEPSYAPCTIHHLMGKSHGLVTCAACRLKNSTLHDDLDDGDLEQ

SEQ ID NO: 540 - protein, 319 aa, Artificial Sequence
  Description of Artificial Sequence: Synthetic polypeptide
MELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRLVGAVGQKGSECCS

SEQ ID NO: 541 - protein, 662 aa, Artificial Sequence
  Description of Artificial Sequence: Synthetic polypeptide
MRSYYEVIVQLPNDVESQVPGISDSFVNWITSREWTLPEDADWDLDQVDQVQLTLGDKIQREIRTHWGTMAKEPDFHYFIQLEQGEVFFHLHVLLETCSVKPMVLGRYIRHIQQKIVSKVYCATSLRWKDGCVVTKTKNFGGANKVRAESYIPAYLIPKQQPEVQWAWTNVPEYIKACLHRELRASLARLHFEEAGVSQSKENLARTADGAPVMPTRVSKRYMELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRYRIKCSKHCGMDKMLFPCQICESMNRDINICAIHKTTDCKECFPDYGDKDDVELPPCTEHNVSRCYQCHSGELYRVTSDSDEKPAPESDEGTEPSYAPCTIHHLMGKSHGLVTCAACRLKNSTLHDDLDDGDLEQ

SEQ ID NO: 542 - protein, 541 aa, Artificial Sequence
  Description of Artificial Sequence: Synthetic polypeptide
MRSYYEVIVQLPNDVESQVPGISDSFVNWITSREWTLPEDADWDLDQVDQVQLTLGDKIQREIRTHWGTMAKEPDFHYFIQLEQGEVFFHLHVLLETCSVKPMVLGRYIRHIQQKIVSKVYCATSLRWKDGCVVTKTKNFGGANKVRAESYIPAYLIPKQQPEVQWAWTNVPEYIKACLHRELRASLARLHFEEAGVSQSKENLARTADGAPVMPTRVSKRYMELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRLVGAVGQKGSECCS

SEQ ID NO: 543 - protein, 743 aa, Artificial Sequence
  Description of Artificial Sequence: Synthetic polypeptide
MSLISDAIPDWLERLVKKGVNAAADFYHLESGPPRPKANQQTQESLEKDDSRGLVFPGYNYLGPFNGLDKGEPVNEADAAALEHDKAYDLEIKDGHNPYFEYNEADRRFQERLKDDTSFGGNLGKAIFQAKKRVLEPFGLVEDSKTAPTGDKRKGEDEPRLPDTSSQTPKKNKKPRKERPSGGAEDPGEGTSSNAGAAAPASSVGSSIMAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 544 - protein, 598 aa, Artificial Sequence
  Description of Artificial Sequence: Synthetic polypeptide
TAPTGDKRKGEDEPRLPDTSSQTPKKNKKPRKERPSGGAEDPGEGTSSNAGAAAPASSVGSSIMAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 545 - DNA, 4694 bp, Artificial Sequence
  Description of Artificial Sequence: Synthetic polynucleotide
tggccagtttccaagacaggctcgctcgctcactcgggccggggccccaaaggggcccctagcgaccgcttcgcggtcgcggcccgagtgagcgagcgagcctgtcttggaaactggccagcactccggtgaggtaatgccgtcacgtggtcgggaatgggaacgggaaatctcgcgagaacgtaaacaaatataagacggcgccacacggcgctgcgtcatacgcgcgcgcgcaccggcgagatgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataaatgattgaaatgtagccatgtctctcatttctgatgcgattccagattggttggagcggttggtcaaaaagggagtgaatgctgcagctgatttctaccatttggaaagcggtcctcctcgtcctaaggcaaatcagcaaactcaagaatctcttgaaaaggacgattcgagaggtctcgtgttcccaggctacaattatctaggccctttcaacggtctagataaaggagaacccgtcaacgaggcagacgctgccgccttagaacacgacaaggcttacgacctcgaaatcaaggacgggcacaacccgtactttgagtacaacgaggccgacagacgtttccaggaacgtctcaaagacgatacctcctttggaggcaatttaggtaaagccatcttccaggccaaaaagagggttctcgaaccctttggtctggtggaagactcaaagacggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaaattaaacccttcaataaaccgtttatgcgtaactgtatttccgtctcctgtcgttattcagtcacatgatgcggcattacctcaccggagtgctggccagtttccaagacaggctcgctcgctcactcgggccggggccccaaaggggcccctagcgaccgcttcgcggtcgcggcccgagtgagcgagcgagcctgtcttggaaactggcca

SEQ ID NO: 546 - DNA, 2211 bp, Artificial Sequence
  Description of Artificial Sequence: Synthetic polynucleotide
atggctgctgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgcagcggccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcagactatcagctcccgtacgtgctcgggtcggctcacgagggctgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 547 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSDYQLPYVLGSAHEGCLPPFPADVFMVPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 548 - DNA, 2211 bp, Artificial Sequence
  Description of Artificial Sequence: Synthetic polynucleotide
atggcttccgatggttatcttccagattggctcgaggacaacctctctgagggcatccgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcagagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcccatttgggccaaaattcctcacacagatggacactttcacccgtctcctcttatgggcggctttggacttaagcacccgcctcctcagatcctcatcaaaaacacgcctgttcctgcgaatcctccggcagagttttcggctacaaagtttgcttcattcatcacccagtattctactggccaagtcagcgtggagattgaatgggagctgcagaaagaaaacagcaaacgctggaatcccgaagtgcagtatacatctaactatgcaaaatctgccaacgttgatttcactgtggacaacaatggactttatactgagcctcgtcccattggcacccgttacctcacccgtcccctgtaa

SEQ ID NO: 549 - protein, 736 aa, Artificial Sequence
  Description of Artificial Sequence: Synthetic polypeptide
MASDGYLPDWLEDNLSEGIREWWDLKPGAPKPKANQQKQDDGRGLVLPGYKYLGPFNGLDKGEPVNAADAAALEHDKAYDQQLRAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 550 - DNA, 2211 bp, Artificial Sequence
  Description of Artificial Sequence: Synthetic polynucleotide
atggctgctgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgcagcggccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcagactatcagctcccgtacgtgctcgggtcggctcacgagggctgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacctgaacagaactcagaatcagtccggaagtgcccaaaacaaggacttgctgtttagccgggggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccactgaaagatttgggactgtggcagtcaatctccagagcagcagcacagaccctgcgaccggagatgtgcatgccatgggagccttacctggaatggtgtggcaagacagagacgtatacctgcagggtcctatttgggccaaaattcctcacacggatggacactttcacccgtctcctctcatgggcggctttggactcaagaacccgcctcctcagatcctcatcaaaaacacgcctgttcctgcgaatcctccggcggagttttcagctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 551 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSDYQLPYVLGSAHEGCLPPFPADVFMVPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 552 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcaatcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcgacgggggccagcaacgacaaccactacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgatcaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacataaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaaacgctggaatcccgaagtgcagtatacatctaactatgcaaaatctgccaacattgatttcactgtggacaacaatggactttatactgagcctcgccccattggcacccgttacctcacccgtccccagtaa

SEQ ID NO: 553 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANIDFTVDNNGLYTEPRPIGTRYLTRPQ

SEQ ID NO: 554 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtaccttcggtataaccacgccgacgccgagtttcaggagcgtctgcaagaagatacgtcttttgggggcaacctcgggcgagcagtcttccaggccaaaaagagggttctcgaacctctcggtctggttgaggaagcggctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctcccgcagccccctcaggtgtgggatctcttacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttaccggcagcagtgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctcacccgtcccctgtaa

SEQ ID NO: 555 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEQSPQEPDSSSGIGKTGQQPAKKRLNFGQTGDSESVPDPQPLGEPPAAPSGVGSLTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQCVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 556 - DNA, 2211 bp, Artificial Sequence
  Description of Artificial Sequence: Synthetic polynucleotide
atggctgccgatggttatcttccagattggctcgaggacaacctctctgagggcattcgcgaatggtgggacttgaaacctggagccccgaaacccaaagtcaaccagcaaaagcaggacaacgctcggggtcttgtgcttccgggttacaaatacctcggacccttcaacggactcgacaagggggagcccgtcaacgcggcggacgcagcggccctcgagcacgacaaggcctacgaccagcagctcaaagcgggtgacaatccgtaccttcggtataaccacgccgacgccgagtttcaggagcgtctgcaagaagatacgtcttttgggggcaaccttggacgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttaccttcagctacacttttgaggacgttcctttccacagcagctacgctcacagccagagcctggaccggctgatgaatcctctcatcgaccagtacctgtattacctgaacagaactcagaatcagtccggaagtgcccaaaacaaggacttgctgtttagccgtgggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccactgaaagatttgggactgtggcagtcaatctccagagcagcagcacagaccctgcgaccggagatgtgcatgccatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 557 - protein, 736 aa, Artificial Sequence
  Description of Artificial Sequence: Synthetic polypeptide
MAADGYLPDWLEDNLSEGIREWWDLKPGAPKPKVNQQKQDNARGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 558 - DNA, 2208 bp, Artificial Sequence
  Description of Artificial Sequence: Synthetic polynucleotide
  misc_feature (955)..(955): n is a, c, t, or g
  misc_feature (971)..(972): n is a, c, t, or g
  misc_feature (981)..(981): n is a, c, t, or g
  misc_feature (986)..(986): n is a, c, t, or g
  misc_feature (1235)..(1235): n is a, c, t, or g
  misc_feature (1694)..(1696): n is a, c, t, or g
  misc_feature (1698)..(1698): n is a, c, t, or g
  misc_feature (1763)..(1765): n is a, c, t, or g
  misc_feature (1778)..(1778): n is a, c, t, or g
  misc_feature (2204)..(2204): n is a, c, t, or g
atggctgccgatggttatcttccagattggctcgaggacaacctctctgagggcattcgcgaatggtgggacttgaaacctggagccccgaaacccaaagtcaaccagcaaaagcaggacaacgctcggggtcttgtgcttccgggttacaaatacctcggacccttcaacggactcgacaagggggagcccgtcaacgcggcggacgcagcggccctcgagcacgacaaggcctacgaccagcagctcaaagcgggtgacaatccgtaccttcggtataaccacgccgacgccgagtttcaggagcgtctgcaagaagatacgtcttttgggggcaaccttggacgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccacttttcaccacgtgactggcagcgactcatcaataacaattggggattccggcccaagagactcaacttcaaactcttcaacntccaagtcaaggaggnnacgacgaangatgncgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttacctncagctacacttttgaggacgttcctttccacagcagctacgctcacagccagagcctggaccggctgatgaatcctctcatcgaccagtacctgtattacctgaacagaactcagaatcagtccggaagtgcccaaaacaaggacttgctgtttagccgtgggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagagannncnaagccactaaccccgtggccactgaaagatttgggactgtggcagtcaatctccaagcagcacannnaccctgcgaccgnagatgtgcatgccatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtccccngtaa

SEQ ID NO: 559 - protein, 723 aa, Artificial Sequence
  Description of Artificial Sequence: Synthetic polypeptide
MAADGYLPDWLEDNLSEGIREWWDLKPGAPKPKVNQQKQDNARGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNQVKETTDVTTIANNLTSTVQVFSDSEYQLPYVLGSAHQGCLPPFPADVFMIPQYGYLTLNNGSQAVGRSSFYCLEYFPSQMLRTGNNFTSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDEDKFFPMSGVMIFGKESAGASNTALDNVMITDEEATNPVATERFGTVAVNLQSSPATDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 560 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggtcagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacgctccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatctgtaa

SEQ ID NO: 561 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDAPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNL

SEQ ID NO: 562 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcaaactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcgggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacgaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtatacagagcctcgccccattggcaccagatacctgactcgtaatctgtaa

SEQ ID NO: 563 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDANSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSRAVGRSSFYCLEYFPSQMLRTGNNFTFSYTFEDVPFHSSYAHSQSLDRLMNPLIDQYLYYLSRTDTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYTEPRPIGTRYLTRNL

SEQ ID NO: 564 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcgacgggggccagcaacgacaaccactacttcggctacagcaccccctgggggtattttgactttaacagattccactgccacttttcaccacgtgactggcagcgactcatcaacaataactggggattccggcccaagagactcagcttcaagctcttcaacatccaggtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgatcaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacggacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcactcaatactccacaggacaagtgagcgtggaaattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 565 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 566 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDTPSGTTTQSRLQFSQAGASDIRNQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNQ

SEQ ID NO: 567 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggaacgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcggaaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatcagtaa

SEQ ID NO: 568 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgatccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtatgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatctgtaa

SEQ ID NO: 569 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNL

SEQ ID NO: 570 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatgactgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcaactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 571 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggggcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacgggcggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactggaggtgtatatagtgaaccccgccccattggcaccagatacctgactcgtaatctgtaattgcttgttaatcaataaaccgtttaattcgtttcagttgaactgcggcc

SEQ ID NO: 572 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggactcggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattgacaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 573 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcctccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggatccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccaggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 574 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacagggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaagaaaaacagcaagcgctggaacccggagatccagtacacttccaactattacaagtctaataatgttgaatttgctgttaacactgaaggtgtatatagtgaaccccgccccattggcaccagatacctgactcgtaatctgtaattgcttgttaatcaataaaccgtttaattcgtttcagttgaactgcggcc

SEQ ID NO: 575 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacgggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 576 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagtagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggatttcggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 577 - DNA, 2580 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcgggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggaactgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaatt

SEQ ID NO: 578 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtctttcaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcatgtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 579 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccgatcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacgtacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 580 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgccacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgctgccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacatgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcaatgtggccggacccagcaacatggctgtccagggaagaaactacatacctggacccagctaccgacaacaacgtgtctcaaccactgtgactcaaaacaacaacagcgaatttgcctggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcatggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 581 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 582 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagcggcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 583 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcgcggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 584 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaaattgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccagtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattgcaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 585 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgtctgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgataagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 586 - protein, 736 aa, Artificial Sequence
  Description of Artificial Sequence: Synthetic polypeptide
MTADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKQLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 587 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTGGNFHPSPLMGGFGMKHPPPQILIKNTPVPADPPTAFNKDKLNSFITQYSTGQVSVEIEWELQKENSKRWNPEIQYTSNYYKSNNVEFAVNTGGVYSEPRPIGTRYLTRNL

SEQ ID NO: 588 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIDKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 589 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVLQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGSSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 590 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDRAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKKNSKRWNPEIQYTSNYYKSNNVEFAVNTEGVYSEPRPIGTRYLTRNL

SEQ ID NO: 591 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQARAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 592 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAVDAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 593 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPREPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 594 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASCGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 595 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPINAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTYGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 596 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPHDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFNVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSMEIEWELQKENSKRWNPEIQYTSNYYKSNNVEFAVNTEGVYSEPRPIGTRYLTRNL

SEQ ID NO: 597 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 598 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWERQKENSKRWNPEIQYTSNYYKSNNVEFAVNTEGVYSEPRPIGTRYLTRNL

SEQ ID NO: 599 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFADSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 600 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEIAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYCKSNNVEFAVNTEGVYSEPRPIGTRYLTRNL

SEQ ID NO: 601 - protein, 736 aa, Artificial Sequence; identical to SEQ ID NO: 597
  Description of Artificial Sequence: Synthetic polypeptide

SEQ ID NO: 602 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcggctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctgggacccggagatccagtacacttccaactattacaagtctaataatgttgaatttgctgttaatactgaaggtgtatatagtgaaccccgccccattggcaccagatacctgactcgtaatctg

SEQ ID NO: 603 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccgcttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacgcccctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 604 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcagcgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccgcgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 605 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacacggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 606 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcggctcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtagcaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggcagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagcacacttccaactattacaagtctaataatgttgaatttgctgttaatactgaaggtgtatatagtgaaccccgccccattggcaccagatacctgactcgtaatctg

SEQ ID NO: 607 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaggctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaagccaaggaatacttccgggtatggtttggcaggacagagatgtgtacctgcaaggacccatttgggccaaaattcctcacacggacggcaactttcacccttctccgctgatgggagggtttggaatgaagcacccgcctccccagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 608 - DNA, 2205 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgcccgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctggaggtattttgacttcaacagattccactgccacttctcaccacgtgactggcagcgactcatcaacaactggggattccggcctaagcgactcaacttcaagctcttcaacattcaggtcaaagaggttacggacaacaatggagtcaagaccatcgccaataaccttaccagcacggtccaggccttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacgagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 609 - DNA, 2205 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggacaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccaattcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 610 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagccatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcggctcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgacaaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 611 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaatgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccagaccaaaaagaggcttcttgaacctcttggtctggttgaggaagcggctaagacggctcctggaaagaagaggcctgtagagcagtctcctcaggaaccgggctcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 612 - DNA, 2208 bp, Artificial Sequence
  Description of Artificial Sequence: Synthetic polynucleotide
atggctgccgatggttattttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaatctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatctcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctgtggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 613 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtccggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagcggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 614 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcggggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtccggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcggcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 615 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacctgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 616 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaagaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 617 - DNA, 2208 bp, Artificial Sequence
  Description of Artificial Sequence: Synthetic polynucleotide
  misc_feature (1325)..(1325): n is a, c, t, or g
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaccagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccnatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccggatatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 618 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagctacaaagaaggagaggacagtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagaccctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 619 - DNA, 2208 bp, Artificial Sequence; identical to SEQ ID NO: 602
  Description of Artificial Sequence: Synthetic polynucleotide

SEQ ID NO: 620 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccagggcaaatcaacaacatcaagacaacgctcgaggtcttgtgcttccgggttacaaataccttggacccggcaacggactcgacaagggggagccggtcaacgcagccgacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactgtcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaacgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcccatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 621 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaagaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccacccatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatggtgaaccccgccccattggcaccagatacctgactcgtaatctg

SEQ ID NO: 622 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgaccggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 623 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcagccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcaattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccggcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaagaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 624 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacagataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggtaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtatcggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccgtcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtggaccccgccccattggcaccagatacctgactcgtaatctg

SEQ ID NO: 625 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 626 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacgtcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggaggcaacccgtgcctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcagatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaaggccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattgacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatggatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacgggcggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 627 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagcctaataatgttgaatttgctgttaatactgaaggtgtatatagtgaaccccgccccattggcaccagatacctgactcgtaatctg

SEQ ID NO: 628 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacaacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcctcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgagatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctactatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 629 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgtgcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcacgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattgggccccgatacctgactcgtaatttt

SEQ ID NO: 630 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacaacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgagatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 631 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggcggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcgagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagtccagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgcctcaaccactgtgactcaaaacaacaacagcgaatttgcttggcctggagcttcttcttgggctctcaatggacgtaatagcttgatgaatcctggacctgctatggccagccacaaagaaggggaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 632 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagcccccccaggtgtgggatctcttacaatggcttcaggtggtggcgcaccagtggcggacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattagcggttctggacagaatcaacaaacgctaaaattcagtgtggccggacccagcaacatggctgtccagggaagaaactacatacctggacccagctaccgacaacaacgtgtctcaaccactgtgactcaaaacaacagcagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatactttcgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 633 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 634 - DNA, 2208 bp, Artificial Sequence; identical to SEQ ID NO: 633
  Description of Artificial Sequence: Synthetic polynucleotide

SEQ ID NO: 635 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcgactacagcaccccctgggggtattttgacttcaacagattccactgccacttctcaccacgtgactggcagcggctcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcagggcagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 636 - DNA, 2208 bp, Artificial Sequence; identical to SEQ ID NO: 633
  Description of Artificial Sequence: Synthetic polynucleotide

SEQ ID NO: 637 - DNA, 2208 bp, Artificial Sequence
  Description of Artificial Sequence: Synthetic polynucleotide
atggctgccgatggttatcctccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggggacaacccgcacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcccgtagagcagtctcctcaggaaccggactcctccgcgggtattggcaaatcgggtgcacagcccgctaagaagagactcaatttcggtcagactggcgacactgagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaggctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 638 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcggacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagtttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 639 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacttacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcaccaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatatcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 640 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagtttagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttctggcaaacaaggaactggaagagacaacgtggatgcgaacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttgaaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 641 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatagcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcgaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagcttttcaacattcgggtcaaagaggttacggacaacaatggagtcaagaccatcaccaataaccttaccagcacggtccaggtcttcacggactcagactatcagctcccgtacgtgcttgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcgaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 642 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggcgcacagcccgctaaaaagagactcaatttcggtcagactggcgacacagagccagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcgggcgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgcgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 643 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgggttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagtccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggagctggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 644 - DNA, 2208 bp, Artificial Sequence
  Description of Artificial Sequence: Synthetic polynucleotide
  misc_feature (377)..(377): n is a, c, t, or g
atggctgccgatggttatcttccagattggctcgaggacaaccttagtgaaggaattcgcgagaggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcntgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcggggaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcccggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 645 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 646 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccagagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctggactctttcatcacccagtattctactggccaagtcagcgtggagatcgagtgggagctgcagaaggaaaacagcaagcgctggaacccggtgatccagtacacttccaactattacaagtctaataatgttgaatttgctgttaatactgaaggtgtatatagtgaaccccgccccattggcaccagatacctgactcgtaatctg

SEQ ID NO: 647 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtggggcctactacaatggcttcaggcggtggcgcaccaatggcagacaataacgaaggcgtcgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgttacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagccacaaagcttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 648 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagagacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcgttcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 649 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacccgcggtataaccacgccgacgccgagtttcaggagcgtctgcaagaagatacgtcttttgggggcaacctcgggcgagcagtcttccaggccaagaagcgggttctcgaacctctcggtctggttggggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctcccatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 650 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacgacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgcgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggcctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacggacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 651 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcggctcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctcccatcgaccaatacctgtattacctgaacagaactcaaaatcagtccgggagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgactttactgtggacaacaatggactttatactgagcctcgccccattggcacccgttaccttacccgtcccctg

SEQ ID NO: 652 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaagagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccgcaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctgtggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 653 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcaactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcaccagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccgacgttgattttactgtggacaacaatggactttatactgagcctcgccccattggcacccgttaccttacccgtcccctg

SEQ ID NO: 654 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaagagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccgcaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcctccgtacgtcctcggctctgcgcaccagggctgcctccctccgttcccggcggacgtgttcatgattccgcaatacggccacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgacgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 655 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaagagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctacgggaacattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaccacgcctgttcctgcgaatcctccggcggagttttcagctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgattttactgtggacgacaatggactttatactgagcctcgccccattggcacccgttaccttacccgtcccctg

SEQ ID NO: 656 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgctacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacgacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 657 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagctccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagcgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcgaaatctgccaacgttgattttactgtggacaacaatggactttatactgagcctcgccccgttggcacccgttaccttacccgtcccctg

SEQ ID NO: 658 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccatacctgcggtataaccacgccgacgccgagtttcaggagcgtctgcaagaaaatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccactttccaccacgtgactggcagcgactcatcaacaacaattggggattccggcccaagagactcaacttcaaactcttcaacatccaagtcaaggaggtcacgtcgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggtccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 659 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcacgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgggcctcgccccattggcacccgttaccttacccgtcccctg

SEQ ID NO: 660 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgccccaggaaattggcattgcgactccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcacagctatggcctcacacaaagacgacgaagacaagttctttcccatgagcggtgtcatgatttttggaaaagagagcgccggagcttcaaacactgcattggacaatgtcatgattacaggcgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 661 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacagactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaggaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcgccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcggccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatatagcctcaatgggcgtgaatccatcatcaaccctggcactgctatggcctcacacaaagacgacgaagacaagttctttcccatgggcggtgtcatgatttttggaaaagagagcgccggagcttcaaacactgcattggacaatgccatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 662 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcggcagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactctaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggaacattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 663 - DNA, 2208 bp, Artificial Sequence
  Description of Artificial Sequence: Synthetic polynucleotide
atggctgccgatggttatctcccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcagcgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaagagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgccaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 664 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaaggggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 665 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgtttatgattccgcagtacggctacctaacgctcaacaatggcagccaggccgtgggacgttcatccttttactgcccggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcaacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 666 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcgacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 667 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcagggcgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccaacactcgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagttacgggcacagccagagcctggaccggctgatgaatcttctcatcgaccaatacctgtattacctgaacagaactcaaaatcagtccggaagtgcccaaaacaaggacttgctgtttagccgtgggtctccagctggcatgtttgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 668 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccaacacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaatgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgcggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 669 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacgggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtccgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 670 - DNA, 2208 bp, Artificial Sequence
  Description of Artificial Sequence: Synthetic polynucleotide
  misc_feature (305)..(305): n is a, c, t, or g
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggngcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcggcagagtcatcaccaccagcacccgcacctgggccttgcccacctacaataaccacctctacaagcaaatctccagtgcttcaacgggggccagcaacgacaaccactacttcggccacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgtccccggcggacgtgttcatgattccgcagtacggctacctaacactcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcaacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 671 - DNA, 2208 bp, Artificial Sequence
  Description of Artificial Sequence: Synthetic polynucleotide
atggctgccgatggttattttccagattggctcgaggacaacctttctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaggacaggccagcagcccgctaaaaagagactcaattttggtcagactggcgactcagagtcagtccccgacccacaacctctcggagaacctccagcgacccccgctgctgtgggacctactacaatggcttcaggcggtggcgcaccaatggcagacaataacgaaggtgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcccagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatagtgagcctcgccccattggcacccgttaccttacccgtcccttg

SEQ ID NO: 672 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaacctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagactacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 673 - DNA, 2208 bp, Artificial Sequence
  Description of Artificial Sequence: Synthetic polynucleotide
atggctgccgatggttatcctccagattggctcgaggacaacctctctgagggcattcgcgagtggtgggacttgaaacctggagtcccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 674 - DNA, 2196 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagccttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgacccatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctt

SEQ ID NO: 675 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactctcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 676 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgacctatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggaacttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 677 - DNA, 2208 bp, Artificial Sequence
  Description of Artificial Sequence: Synthetic polynucleotide
atggctgccgatggttatcttccagattggctcgaggacagcctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacgatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgcccaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaataccagtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 678 - DNA, 2208 bp, Artificial Sequence; identical to SEQ ID NO: 669
  Description of Artificial Sequence: Synthetic polynucleotide

SEQ ID NO: 679 - DNA, 2205 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcgggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctg

SEQ ID NO: 680 - protein, 736 aa, Artificial Sequence
  Description of Artificial Sequence: Synthetic polypeptide
MAADGYLPDWLEDNLSEGIREWWALKPGAPQPKANQQHQDNARGLVLPDYKYLGPGNGLDKGEPVNAADVAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDGVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLPKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 681 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKRRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQIKEVTDNNGVKTIANNLTSTVQVFTDLDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 682 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVSAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVSDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPSPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDDVDADKVIITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 683 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHAGAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGAGGVGSSSGNWHCDSQWLGDRVVTTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHGGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRSYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 684 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVVTTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSHAHSQSLDRLMNPLIDQYLHYLSKTINGSGQNQQTLKFSVAGHSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIGWELQKENSKRWNPEIQYTSNYYKSNNVEFAVNTEGVYSEPRPIGTRYLTRNL

SEQ ID NO: 685 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNRLYKQISNSTSGGSSNDNAYFGYSTPWGYFDFNRFHCHFSPRDWQRLINNNWGFRPKRLNFKPFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 686 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 687 - protein, 736 aa, Artificial Sequence; identical to SEQ ID NO: 686
  Description of Artificial Sequence: Synthetic polypeptide

SEQ ID NO: 688 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKSGQQPAKKRLNFGQTGDSESVPDPQPLGEPPATPAALGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSKAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 689 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 690 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFGYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWDPEIQYTSNYYKSNNVEFAVNTEGVYSEPRPIGTRYLTRNL

SEQ ID NO: 691 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCRFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNAPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 692 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVSAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 693 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNTAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 694 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGSNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPAATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQHTSNYYKSNNVEFAVNTEGVYSEPRPIGTRYLTRNL

SEQ ID NO: 695 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFRLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQSQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 696 - protein, 735 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWRYFDFNRFHCHFSPRDWQRLINNWGFRPKRLNFKLFNIQVKEVTDNNGVKTIANNLTSTVQAFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDELNSFITQYSTGQVSVEIEWELQKENSKRWNPEIQYTSNYYKSNNVEFAVNTEGVYSEPRPIGTRYLTRNL

SEQ ID NO: 697 - protein, 735 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQDKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 698 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRAITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMTTNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 699 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQTKKRLLEPLGLVEEAAKTAPGKKRPVEQSPQEPGSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 700 - protein, 736 aa, Artificial Sequence
  Description of Artificial Sequence: Synthetic polypeptide
MAADGYFPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGESPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYLPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAVASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 701 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGPVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQAATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 702 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGPVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWRRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 703 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNLYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 704 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 705 - protein, 736 aa, Artificial Sequence
  Description of Artificial Sequence: Synthetic polypeptide
  MOD_RES (442)..(442): Xaa = any amino acid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISTSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDXYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPDMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 706 - protein, 736 aa, Artificial Sequence; identical to SEQ ID NO: 686
  Description of Artificial Sequence: Synthetic polypeptide

SEQ ID NO: 707 - protein, 736 aa, Artificial Sequence; identical to SEQ ID NO: 690
  Description of Artificial Sequence: Synthetic polypeptide

SEQ ID NO: 708 - protein, 736 aa, Artificial Sequence
  Description of Artificial Sequence: Synthetic polypeptide
MAADGYLPDWLEDNLSEGIREWWALKPGAPQPRANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDCQLPYVLGSAHEGCLPPFPADVFMIPQYGYLTLNDGSQAVGRSSFYCLEYFPSQMLRTGNNFQFSYEFENVPFHSSYAHSQSLDRLTNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESHGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 709 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPPIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYGEPRPIGTRYLTRNL

SEQ ID NO: 710 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDRQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 711 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCNSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPGNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 712 - protein, 736 aa, Artificial Sequence
  Description of Artificial Sequence: Synthetic polypeptide
MAADGYLPDWLEDNLSEGIREWWALKPGAPQPKANQQHQDNARGLVLPGYRYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTVANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSGPRPIGTRYLTRNL

SEQ ID NO: 713 - protein, 736 aa, Artificial Sequence; identical to SEQ ID NO: 123
  Description of Artificial Sequence: Synthetic polypeptide

SEQ ID NO: 714 - protein, 736 aa, Artificial Sequence
  Description of Artificial Sequence: Synthetic polypeptide
MAADGYLPDWLEDNLSEGIREWWALKPGAPQPKANQQRQDNARGLVLPGYKYLGPGNGLDKGEPVNAADAAALEHDKAYDQQLKAGGNPCLKYNHADAEFQERLKEDTSFGGNLGRAVFQAKKRLLEPLGLVEEAAKTAPGKKRPVEQSPQEPDSSAGIGRSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKAIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIDGSGQNQQTLKFSVAGPSNMAVQGRNYIPGPSYRQQRVSTTVTQNNNSEFAWPGASSWALNGRNSLMDPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTGGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 715 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKPNNVEFAVNTEGVYSEPRPIGTRYLTRNL

SEQ ID NO: 716 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHNKAYDQQLKAGDNPYLKCNHADAEFQERLKEDTSFGGNLGRAVFQAKKRPLEPLGLVEEAAKTAPGKKRPVEQSPQEPDSSAGIGKSGAQPAKKRLNFGQTGDTESVPDPQPIGEPPAAPSGVRSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPTMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 717 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALVHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFTIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGPRYLTRNF

SEQ ID NO: 718 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHNKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVRSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 719 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFELFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQSSYEFENVPFHSSYAHSQSLDRLMNPLIDQYLYYLSKTINGSGQNQQTLKFSVAGPSNMAVQGRNYIPGPSYRQQRASTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 720 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPPGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTISGSGQNQQTLKFSVAGPSNMAVQGRNYIPGPSYRQQRVSTTVTQNNSSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILSGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 721 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 722 - protein, 736 aa, Artificial Sequence; identical to SEQ ID NO: 721
  Description of Artificial Sequence: Synthetic polypeptide

SEQ ID NO: 723 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLDYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQGRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 724 - protein, 736 aa, Artificial Sequence; identical to SEQ ID NO: 721
  Description of Artificial Sequence: Synthetic polypeptide

SEQ ID NO: 725 - protein, 736 aa, Artificial Sequence
  Description of Artificial Sequence: Synthetic polypeptide
MAADGYPPDWLEDNLSEGIREWWALKPGAPQPKANQQHQDNARGLVLPGYKYLGPGNGLDKGEPVNAADAAALEHDKAYDQQLKAGDNPHLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDRLNSFITQYSTGQVSVEIEWELQKENSKRWNPEIQYTSNYYKSNNVEFAVNTEGVYSEPRPIGTRYLTRNL

SEQ ID NO: 726 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 727 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLTNNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYIPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 728 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLISGKQGTGRDNVDANKVMITNEEEIKTTNPVATESYGQVATNHQSAQAQAQTGWVQNQGILPGMVWQDRDVYLQGPIWAKIPHTDGNFHPSPLMGGFEMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 729 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTIASGGGAPVADNNEGADGVGSSSGNWHCDSQWLGDRVITTSTRTWALPTYNNHLYKRISNSTSGGSSNDNAYFGYSTPWGYFDFNRFHCHFSPRDWQRLINNNWGFRPKRLNFKLFNIRVKEVTDNNGVKTITNNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTRNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 730 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTEPVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPAGVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTATQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 731 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAGFQERLKEDTSFGGNLGRAVFQAKKRLLEPLGLVEEAAKTAPGKKRPVEQSPQEPDSSAGIGKSGAQPAKKRLNFGQTGDTESVPVPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGAGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 732 - protein, 736 aa, Artificial Sequence
  Description of Artificial Sequence: Synthetic polypeptide
  MOD_RES (126)..(126): Xaa = any amino acid
MAADGYLPDWLEDNLSEGIRERWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLXEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSPDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 733 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 734 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLDSFITQYSTGQVSVEIEWELQKENSKRWNPVIQYTSNYYKSNNVEFAVNTEGVYSEPRPIGTRYLTRNL

SEQ ID NO: 735 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGVDGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKLASFITQYSTGQVSVEIEWELQKENSKRWNPEVQYTSNYAKSANVDFTVDNNGLYTEPRPIGTRYLTRPL

SEQ ID NO: 736 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKRRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 737 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTSFGGNLGRAVFQAKKRVLEPLGLVGEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPPIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 738 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPRPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGPPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 739 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGGSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPPIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 740 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 741 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQQLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSTSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSADVDFTVDNNGLYTEPRPIGTRYLTRPL

SEQ ID NO: 742 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQPPYVLGSAHQGCLPPFPADVFMIPQYGHLTLNNGSQAVGRSSFYCLEYFPSQMLRTGNNFTFSYTFEEVPFHSSYAHSQSLDRLTNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 743 - protein, 736 aa, Artificial Sequence
  Description of Artificial Sequence: Synthetic polypeptide
MAADGYLPDWLEDNLSEGIREWWDLKPGAPKPKANQQEQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHATGTLPGMVWQDRDVYLQGPIWAKIPHTDGHFHPSPLMGGFGLKNPPPQILIKTTPVPANPPAEFSATKFASFITQYSTGQVSVEIEWELQKENSKRWNPEVQYTSNYAKSANVDFTVDDNGLYTEPRPIGTRYLTRPL

SEQ ID NO: 744 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSLQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNDNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 745 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEAPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPVGTRYLTRPL

SEQ ID NO: 746 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQENTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFPPRDWQRLINNNWGFRPKRLNFKLFNIQVKEVTSNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 747 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGTSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTGPRPIGTRYLTRPL

SEQ ID NO: 748 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNAPGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITGEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 749 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNRLDKGEPVNAADAAALEHDKAYDQQLKAGDNPYLRYNHADAEFQERLQEDTSFGGNLGRAVFQAKKRVLEPLGLVEEGAKTAPGRKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGGQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYSLNGRESIINPGTAMASHKDDEDKFFPMGGVMIFGKESAGASNTALDNAMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 750 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGGRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNSTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGTLPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 751 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVSAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKERLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 752 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEGEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 753 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCPEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSNTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 754 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSDTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 755 - protein, 736 aa, Artificial Sequence
  Description of Artificial Sequence: Synthetic polypeptide
MAADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTNTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYGHSQSLDRLMNLLIDQYLYYLNRTQNQSGSAQNKDLLFSRGSPAGMFVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 756 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTNTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLMLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPAATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 757 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 758 - protein, 736 aa, Artificial Sequence
  Description of Artificial Sequence: Synthetic polypeptide
  MOD_RES (102)..(102): Xaa = any amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQXRLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGGRVITTSTRTWALPTYNNHLYKQISSASTGASNDNHYFGHSTPWGYFDFNRFHCHFSPRDWQRLINNNWGFRPKRLNFKLFNIQVKEVTTNDGVTTIANNLTSTVQVFSDSEYQLPYVLGSAHQGCLPPSPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSNTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 759 - protein, 736 aa, Artificial Sequence
  Description of Artificial Sequence: Synthetic polypeptide
MAADGYFPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGRTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSPDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYSEPRPIGTRYLTRPL

SEQ ID NO: 760 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQTSSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDYNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 761 - protein, 736 aa, Artificial Sequence
  Description of Artificial Sequence: Synthetic polypeptide
MAADGYPPDWLEDNLSEGIREWWDLKPGVPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 762 - protein, 732 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQAFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDPYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYL

SEQ ID NO: 763 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHSHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 764 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDLYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGTSNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 765 - protein, 736 aa, Artificial Sequence
  Description of Artificial Sequence: Synthetic polypeptide
MAADGYLPDWLEDSLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTPNNGSQAVGRSSFYCLEYFPSQMLRTGNNFTFSYTFEEVPFHSSYAHSQSLDRLMNPLIDQYQYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 766 - protein, 736 aa, Artificial Sequence; identical to SEQ ID NO: 757
  Description of Artificial Sequence: Synthetic polypeptide

SEQ ID NO: 767 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSRAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 768 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgcctcccgccgtttccagcggacgtcttcatggtccctcagtatggatacctcaccctgaacaacggaagtcaagcggtgggacgctcatccttttactgcccggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcaccctattggaacccggtatctcacacgaaacttgtaa

SEQ ID NO: 769 - DNA, 2211 bp, Artificial Sequence
  Description of Artificial Sequence: Synthetic polynucleotide
atggctgctgatggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactgttgccaataaccttaccagcacggttcaagtgtttacggactcggagtatcaactcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 770 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccggccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacggcaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtgtggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 771 - DNA, 2212 bp, Artificial Sequence
  Description of Artificial Sequence: Synthetic polynucleotide
  misc_feature (1283)..(1283): n is a, c, t, or g
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggaccgggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggtccaagtgtttacggactcggagtatcagctcccgtacgtgctcgggtcggcgcaccaaggctgtctcccgccgtttccagcggacgccttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacggcagctacgctcacagccngagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagacttttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaactcgtaa

SEQ ID NO: 772 - DNA, 2212 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcttgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccatctctacaagcaaatctccggccaatcaggagcttcaaacgacaaccactactttggctacagcaccccctgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatcccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 773 - DNA, 2212 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacgaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtgcctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtagcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatggatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacctgtaa

SEQ ID NO: 774 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacgaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcaacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 775 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacgaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcggacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagtgcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 776 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaaggggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgttcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagttcggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttgaacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 777 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacgaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccacctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 778 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccatctctacaagcaaatctccagccaatcaggagcttcaaacgacaaccactactttggctacagcaccccttggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgccttcatggtccctcagtatggatacctcaccctgaacaacggaagtcaagcggtgggacgctcatccttttactgcctggagtacttcccttcgcagatgctaaggactggaaataacttccaattcagctataccctcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaaggacgatgaagaaaaatttttccctatgcacggcaatctaatatttggcaaagaagggacaacggcaagtaacgcagaattagatagtgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 779 - DNA, 2205 bp, Artificial Sequence
  Description of Artificial Sequence: Synthetic polynucleotide
atgactgacggttaccttccagattggctagaggacaacctctctgagggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcaactggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacctttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgctaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 780 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttcttaccacgtgactggcagcgactcatcaacaacaactggggcgtgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcgacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 781 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacgagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgctaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 782 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacggaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattccccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggcggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 783 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctaccgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 784 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttcagggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaaccccttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacccggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaataactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgcccggacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 785 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaggctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacggaggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 786 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatcctccgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctagtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 787 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacactgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagagcacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 788 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccctgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggtccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgccgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtgcaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctattggaacccgataccttacccgacccctttaa

SEQ ID NO: 789 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacaccgaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcgcgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 790 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacggggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagcgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 791 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttactaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagggggacgtgtacctccaaggacccatctgggccaagatcccagagacgggggcgcactttcacccctctccggccatgggcggattcggactcaagcacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 792 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggtccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccgagaggtggaacccagagatccagtacacaaacaactacaacgacccccagtttgtggactttgccccggacagcaccggggaatacagaaccaccagacctattggaacccgataccttacccgacccctttaa

SEQ ID NO: 793 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacagcgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccgccagacctatcggaacccgataccttacccgacccctttaa

SEQ ID NO: 794 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccctgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatgaccaccaacaaccagagctccaccactgcccccgcgaccggcacgtacaacctccaggaaatcgtgcccggcagcgtgtggatggagagggacgtgtacccccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacaggaccaccagacctatcggaacccgataccttacccgacccctttaa

SEQ ID NO: 795 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcctctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatgaagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 796 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaggcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccaccccgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 797 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacccacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagtcgaacggcatgaccaacaacctccggggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 798 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacagcgtcggcgggcagatggccaccaacaaccagagctccaccactgcccccacgaccggcacgtacaacctccaggaaatcgtgcccggcagcgtgtggatggagagggacgtgtacctccaaggacccatctgggccaagatcccagagacgggggcgcactttcacccctctccggccatgggcggattcagactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 799 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccgcgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcggcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaataccaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 800 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggtagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcggcaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggggcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccctcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 801 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgagccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatgcagaaccaccagacctatcggaacccgataccttacccgacccctttaa

SEQ ID NO: 802 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcctcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtgggccagtacttgtaccgcttcgtgagcacaaataacactggcggagtccagttcaacgagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggccaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 803 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggcctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccatcatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgcccccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 804 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcctctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 805 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgccaacagggcagacgaggtcgcgcgagagcacgacatctcgtacaacgagcagcttgaggcgggagacaacccctacctcaagtacaaccacgcgggcgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccggctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataatactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 806 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagcctcccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccgccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 807 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagccgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgcgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 808 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagcctcccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 809 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagcctcccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgccgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcgccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 810 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgcgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 811 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggctgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagccaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaaccttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggtgcacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccggagatccagtacacaaacaactacaacgacccccagtttgtggactttgccccggacagcaccggggaatacagaaccaccagacctatcggaacccgataccttacccgacccctttaa

SEQ ID NO: 812 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaggcaacgccaacgcctactttggatacagcaccccctgggggtactttgactttaaccgcttccacagccactggagcccccgggactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgcgcccggaaatatcaccagcttctcggacgtgcccgtcagcagcttcatcacccagtacagcaccgggcaggtcaccgtggagatggagtgggagctcaagaagggaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 813 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacgtccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggtgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 814 - DNA, 2175 bp, Artificial Sequence
  Description of Artificial Sequence: Synthetic polynucleotide
  misc_feature (1652)..(1652): n is a, c, t, or g
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaggaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcagcatgctcatcaccancgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 815 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 816 - DNA, 2205 bp, Artificial Sequence; identical to SEQ ID NO: 84
  Description of Artificial Sequence: Synthetic polynucleotide

SEQ ID NO: 817 - DNA, 2234 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaaccgtgtattcgtgtcagtaaaatactgcctc

SEQ ID NO: 818 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCPEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPHPIGTRYLTRNL

SEQ ID NO: 819 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTVANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 820 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISGQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANGNNNSNFPWTAASKYHLNGRDSLVNPGPAMASHKDDEEKFFPMHGNLIFGKEGTTASNAELDNVMITDEEEIRTTNPVATEQCGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 821 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNSHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADAFMVPQYGYLTLNNGSQAVGRSSFYCLEYFPSQMLRTGNNFQFSYTFEDVPFHGSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNS

SEQ ID NO: 822 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQLARKRLNFGQTGDSESVPDPQPLGEPPAAPTSLGSNTMASGGGAPMADNNEGADGVGNSSGNWHCDSQWLGDRVITTSTRTWALPTYNSHLYKQISGQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 823 - protein, 736 aa, Artificial Sequence
  Description of Artificial Sequence: Synthetic polypeptide
MAADGYLPDWLEDNLSEGIREWWALKPGVPQPKANQQHQDDRRGLVLPGYKYLGPGNGLDKGEPVNEADAAALEHDKAYDQQLKAGDNPCLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGSAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMDPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 824 - protein, 736 aa, Artificial Sequence
  Description of Artificial Sequence: Synthetic polypeptide
MAADGYLPDWLEDNLSEGIREWWALKPGVPQPKANQQHQDDRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGNRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 825 - protein, 736 aa, Artificial Sequence
  Description of Artificial Sequence: Synthetic polypeptide
MAADGYLPDWLEDNLSEGIREWWALKPGVPQPKANQQHQDDRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATVQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 826 - protein, 735 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKGILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVFGSAHQGCLPPFPADVFMVPQYGYLTLNNGSQAVGRSSFYCLEYFPSQMLRTGNNFQFSYTFEDVPFHSSYAHSQSSDRLMNPLIDQYLYYLNRTQGTTSGTTNQSRLLFSQAGPQSMSLQARNWLPGPCYRQQRLSKTANDNNNSNFPTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 827 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDEGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNSHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 828 - protein, 668 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNSHLYKQISSQSGASNDNHYFGYSTPWGILTLTDSTATSHHVTGSDSLTTTGDSGPRNSASSSSTSKLKRSRRTMARRLLPITLPARFKCLRTRSISSRTCSGRRTKAVSRRFQRTPSWSLSMDTSPTTEVKRWDAHPFTAWSTSLRRCGLEITSNSAIPSRMYLFTAATLTARVWIAILLLISICTTTERKEQPLEQPTNHGCFLARLGLSLCLCRPEIGYLGPATGNRDFQRLLTTTTTVTFLGQRPANIISMAATRWIQDQLWPVTRTMKKNFSLCTAIRGPYLAWCGKIVTCTFKDLSGQRFLTRMDTFILLLWEALDNIRLLKSSKILRYRQILRRLSARPSLLHLSLSTPLDRSAWKLSGSYRKKTANVGIQRFSTLPTTTSLLMWTLLTLMVFIVNLALLEPGISHETC

SEQ ID NO: 829 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAATGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNLSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 830 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFLPRDWQRLINNNWGVRPKAMRVKIFNIQVKEVTTSNGETTVANNLTSTVQIFADSSYELPYVMDAGQEGSLPPFPNDVFMVPQYGYCGLVTGDTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 831 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDEGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 832 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDGTGAGDGPPEGSTSGAMSDDSEMRAAAGGAAVEGGQGADGVGNASGDWHCDSTWSEGHVTTTSTRTWVLPTYNNHLYKRLGESLQSNTYNGFPTPWGYFDFNRFHCHFSPRDWQRLINNNWGMRPKAMRVKIFNIQVKEVTTSNGETTAANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 833 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYRGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 834 - protein, 734 aa, Artificial Sequence
  Description of Artificial Sequence: Synthetic polypeptide
MTDGYLPDWLEDNLSEGVREWWALQPGAPKPKANQQHQDNARGLVLQGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTRSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSARTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 835 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQERLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETEAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 836 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSSGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 837 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKSTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 838 - protein, 724 aa, Artificial Sequence
  Description of Artificial Sequence: Synthetic polypeptide
MSFVDHPPDWLEEVGEGLREFLGPEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKVRTEEDSKPSTSSDAEAGPSGSQQLQIPAQPASSLGADTMSAGGGGPLGDNNQGADGVGNASGDWHCDSTWMGDRVVTKSTRTWVPPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVACNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 839 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGAYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 840 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADGVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQAFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 841 - protein, 723 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYVPPQPNGMTNNLQGSNTYALENTMIFNSQPANPGTTATYLEGNMLITSESETQPVNRVAYNVGGQMATNNQSSTTAPATGTYNLQEIVPGSVWMEGDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 842 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKVRTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSERWNPEIQYTNNYNDPQFVDFAPDSTGEYRTTRPIGTRYLTRPL

SEQ ID NO: 843 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYSEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTARPIGTRYLTRPL

SEQ ID NO: 844 - protein, 724 aa, Artificial Sequence
  Description of Artificial Sequence: Synthetic polypeptide
MSFVDHPPDWLEEVGEGLREFLGPEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMTTNNQSSTTAPATGTYNLQEIVPGSVWMERDVYPQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 845 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFLCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMKRDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 846 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTPSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 847 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTHKNWFPGPMGRTQGWNLGSGVNRASVSAFATTNRMELEGASYQVPPQSNGMTNNLRGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 848 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYSVGGQMATNNQSSTTAPTTGTYNLQEIVPGSVWMERDVYLQGPIWAKIPETGAHFHPSPAMGGFRLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 849 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFAATNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGGVWMERDVYLQGPIWAKIPETGAHFHPSPAMGGFGLKHPPPMMLIKNTPVPGNTTSFSDVPVSSFITQYSTGQVTVEMEWELKKENSKRWNPEIQYTNNYNDPQFVDFAPDSTGEYRTTRPIGTRYLTRPL

SEQ ID NO: 850 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKVVFQAKKRVLEPFGLVEEGAKTAPTGKRIDDHFPKRKKARTEEDSKPSTSSDAEAGPSGSQQLQIPAQPASSLGADTMSAGGGGPLGGNNQGADGVGNASGDWHCDSTWMGDRVVTKSTRTWVLPSYNNHQYREIKSGSVDGSNANAYFGYSTPWGYFDFNRFHSHWGPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSALATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 851 - protein, 723 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGECRTTRPIGTRYLTRPL

SEQ ID NO: 852 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKILNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVGQYLYRFVSTNNTGGVQFNENLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQATVEMEWELKKENSKRWNPEIQYTNNYNDPQFVDFAPDSTGEYRTTRPIGTRYLTRPL

SEQ ID NO: 853 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTIIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 854 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSLSDVPVSSFITQYSTGQVTVEMEWELKKENSKRWNPEIQYTNNYNDPQFVDFAPDSTGEYRTTRPIGTRYLTRPL

SEQ ID NO: 855 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPANRADEVAREHDISYNEQLEAGDNPYLKYNHAGAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPGYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 856 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPPTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSATTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 857 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQPQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPAPGNITSFSDVPVSSFITQYSTGQVTVEMEWELKKENSKRWNPEIQYTNNYNDPQFVDFAPDSTGEYRTTRPIGTRYLTRPL

SEQ ID NO: 858 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPPTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 859 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPPTSSDAEAGPSGSQQLQIPAQPASSLGADTMSAGGGGPLGDNNQGADGVGNASGDWHCDSTWMGDRVVTKSTRTWVPPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVAVEMEWELKKENSKRWNPEIQYTNNYNDPQFVDFAPDSTGEYRTTRPIGTRYLTRPL

SEQ ID NO: 860 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPAPGNITSFSDVPVSSFITQYSTGQVTVEMEWELKKENSKRWNPEIQYTNNYNDPQFVDFAPDSTGEYRTTRPIGTRYLTRPL

SEQ ID NO: 861 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLAEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRAKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNLEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVVHNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 862 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGGNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPAPGNITSFSDVPVSSFITQYSTGQVTVEMEWELKKGNSKRWNPEIQYTNNYNDPQFVDFAPDSTGEYRTTRPIGTRYLTRPL

SEQ ID NO: 863 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGVHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 864 - protein, 724 aa, Artificial Sequence
  Description of Artificial Sequence: Synthetic polypeptide
  MOD_RES (551)..(551): Xaa = any amino acid
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGSMLITXESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 865 - protein, 736 aa, Artificial Sequence; identical to SEQ ID NO: 39
  Description of Artificial Sequence: Synthetic polypeptide

SEQ ID NO: 866 - protein, 734 aa, Artificial Sequence; identical to SEQ ID NO: 57
  Description of Artificial Sequence: Synthetic polypeptide

SEQ ID NO: 867 - protein, 723 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 868 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 869 - DNA, 2232 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctctagaactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggtaccggcagagacaacgtggatgcggacaaagtcatgataaccaacgaagaagaaattaaaactactaacccggtagcaacggagtcctatggacaagtggccacaaaccaccagagtgcccaaactttggcggtgccttttaaggcacaggcgcagaccggttgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 870 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIQSSQTPRQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 871 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIILGTGTSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQTRTNPEAAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 872 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIILGTGTSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQNGGTSSSAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 873 - protein, 7 aa, Artificial Sequence
  Description of Artificial Sequence: Synthetic polypeptide
TLAVPFK

SEQ ID NO: 874 - protein, 7 aa, Artificial Sequence
  Description of Artificial Sequence: Synthetic polypeptide
KFPVALT

SEQ ID NO: 875 - protein, 6 aa, Artificial Sequence
  Description of Artificial Sequence: Synthetic polypeptide
LAVPFK

SEQ ID NO: 876 - protein, 5 aa, Artificial Sequence
  Description of Artificial Sequence: Synthetic polypeptide
AVPFK

SEQ ID NO: 877 - protein, 4 aa, Artificial Sequence
  Description of Artificial Sequence: Synthetic polypeptide
VPFK

SEQ ID NO: 878 - protein, 6 aa, Artificial Sequence
  Description of Artificial Sequence: Synthetic polypeptide
TLAVPF

SEQ ID NO: 879 - protein, 5 aa, Artificial Sequence
  Description of Artificial Sequence: Synthetic polypeptide
TLAVP

SEQ ID NO: 880 - protein, 4 aa, Artificial Sequence
  Description of Artificial Sequence: Synthetic polypeptide
TLAV

SEQ ID NO: 881 - protein, 7 aa, Artificial Sequence
  Description of Artificial Sequence: Synthetic polypeptide
SVSKPFL

SEQ ID NO: 882 - protein, 7 aa, Artificial Sequence
  Description of Artificial Sequence: Synthetic polypeptide
FTLTTPK

SEQ ID NO: 883 - protein, 7 aa, Artificial Sequence
  Description of Artificial Sequence: Synthetic polypeptide
MNATKNV

SEQ ID NO: 884 - protein, 7 aa, Artificial Sequence
  Description of Artificial Sequence: Synthetic polypeptide
QSSQTPR

SEQ ID NO: 885 - protein, 7 aa, Artificial Sequence
  Description of Artificial Sequence: Synthetic polypeptide
ILGTGTS

SEQ ID NO: 886 - protein, 7 aa, Artificial Sequence
  Description of Artificial Sequence: Synthetic polypeptide
TRTNPEA

SEQ ID NO: 887 - protein, 7 aa, Artificial Sequence
  Description of Artificial Sequence: Synthetic polypeptide
NGGTSSS

SEQ ID NO: 888 - protein, 7 aa, Artificial Sequence
  Description of Artificial Sequence: Synthetic polypeptide
YTLSQGW

SEQ ID NO: 889 - DNA, 21 bp, Artificial Sequence
  Description of Artificial Sequence: Synthetic polynucleotide
aagtttcctgtggcgttgact

SEQ ID NO: 890 - DNA, 21 bp, Artificial Sequence
  Description of Artificial Sequence: Synthetic polynucleotide
actttggcggtgccttttaag

SEQ ID NO: 891 - DNA, 21 bp, Artificial Sequence
  Description of Artificial Sequence: Synthetic polynucleotide
agtgtgagtaagccttttttg

SEQ ID NO: 892 - DNA, 21 bp, Artificial Sequence
  Description of Artificial Sequence: Synthetic polynucleotide
tttacgttgacgacgcctaag

SEQ ID NO: 893 - DNA, 21 bp, Artificial Sequence
  Description of Artificial Sequence: Synthetic polynucleotide
atgaatgctacgaagaatgtg

SEQ ID NO: 894 - DNA, 21 bp, Artificial Sequence
  Description of Artificial Sequence: Synthetic polynucleotide
cagtcgtcgcagacgcctagg

SEQ ID NO: 895 - DNA, 21 bp, Artificial Sequence
  Description of Artificial Sequence: Synthetic polynucleotide
attctggggactggtacttcg

SEQ ID NO: 896 - DNA, 21 bp, Artificial Sequence
  Description of Artificial Sequence: Synthetic polynucleotide
acgcggactaatcctgaggct

SEQ ID NO: 897 - DNA, 21 bp, Artificial Sequence
  Description of Artificial Sequence: Synthetic polynucleotide
aatggggggactagtagttct

SEQ ID NO: 898 - DNA, 21 bp, Artificial Sequence
  Description of Artificial Sequence: Synthetic polynucleotide
tatactttgtcgcagggttgg

SEQ ID NO: 899 - protein, 9 aa, Artificial Sequence
  Description of Artificial Sequence: Synthetic polypeptide
SADNNNSEY

SEQ ID NO: 900 - protein, 9 aa, Artificial Sequence
  Description of Artificial Sequence: Synthetic polypeptide
LIDQYLYYL

SEQ ID NO: 901 - protein, 9 aa, Artificial Sequence
  Description of Artificial Sequence: Synthetic polypeptide
VPQYGYLTL

SEQ ID NO: 902 - protein, 9 aa, Artificial Sequence
  Description of Artificial Sequence: Synthetic polypeptide
TTSTRTWAL

SEQ ID NO: 903 - protein, 9 aa, Artificial Sequence
  Description of Artificial Sequence: Synthetic polypeptide
YHLNGRDSL

SEQ ID NO: 904 - protein, 9 aa, Artificial Sequence
  Description of Artificial Sequence: Synthetic polypeptide
SQAVGRSSF

SEQ ID NO: 905 - protein, 9 aa, Artificial Sequence
  Description of Artificial Sequence: Synthetic polypeptide
VPANPSTTF

SEQ ID NO: 906 - protein, 9 aa, Artificial Sequence
  Description of Artificial Sequence: Synthetic polypeptide
FPQSGVLIF

SEQ ID NO: 907 - protein, 15 aa, Artificial Sequence
  Description of Artificial Sequence: Synthetic polypeptide
YFDFNRFHCHFSPRD

SEQ ID NO: 908 - protein, 15 aa, Artificial Sequence
  Description of Artificial Sequence: Synthetic polypeptide
VGNSSGNWHCDSTWM

SEQ ID NO: 909 - protein, 15 aa, Artificial Sequence
  Description of Artificial Sequence: Synthetic polypeptide
QFSQAGASDIRDQSR

SEQ ID NO: 910 - protein, 13 aa, Artificial Sequence
  Description of Artificial Sequence: Synthetic polypeptide
GASDIRQSRNWLP

SEQ ID NO: 911 - protein, 15 aa, Artificial Sequence
  Description of Artificial Sequence: Synthetic polypeptide
GNRQAATADVNTQGV

SEQ ID NO: 912 - protein, 9 aa, Artificial Sequence
  Description of Artificial Sequence: Synthetic polypeptide
LDRLMNPLI

SEQ ID NO: 913 - protein, 9 aa, Artificial Sequence
  Description of Artificial Sequence: Synthetic polypeptide
QPAKKRLNF

SEQ ID NO: 914 - RNA, 21 nt, Artificial Sequence
  Description of Artificial Sequence: Synthetic oligonucleotide
uuaacgucaguucauaaacuu

SEQ ID NO: 915 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uuaacgucaguucauaaactt

SEQ ID NO: 916 - RNA, 21 nt, Artificial Sequence
  Description of Artificial Sequence: Synthetic oligonucleotide
ugucgguaccgucuaacacuu

SEQ ID NO: 917 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
ugucgguaccgucuaacactt

SEQ ID NO: 918 - RNA, 21 nt, Artificial Sequence
  Description of Artificial Sequence: Synthetic oligonucleotide
uaagcauggagcuagcagguu

SEQ ID NO: 919 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uaagcauggagcuagcaggtt

SEQ ID NO: 920 - RNA, 21 nt, Artificial Sequence
  Description of Artificial Sequence: Synthetic oligonucleotide
uacaacgagacugaauugcuu

SEQ ID NO: 921 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uacaacgagacugaauugctt

SEQ ID NO: 922 - RNA, 21 nt, Artificial Sequence
  Description of Artificial Sequence: Synthetic oligonucleotide
uucaguucauaaaccuggauu

SEQ ID NO: 923 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uucaguucauaaaccuggatt

SEQ ID NO: 924 - RNA, 21 nt, Artificial Sequence
  Description of Artificial Sequence: Synthetic oligonucleotide
uaacgucaguucauaaaccuu

SEQ ID NO: 925 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uaacgucaguucauaaacctt

SEQ ID NO: 926 - RNA, 21 nt, Artificial Sequence
  Description of Artificial Sequence: Synthetic oligonucleotide
uccggucacaacauugugguu

SEQ ID NO: 927 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uccggucacaacauuguggtt

SEQ ID NO: 928 - RNA, 21 nt, Artificial Sequence
  Description of Artificial Sequence: Synthetic oligonucleotide
uugcacgguucuuugugacuu

SEQ ID NO: 929 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uugcacgguucuuugugactt

SEQ ID NO: 930 - RNA, 21 nt, Artificial Sequence
  Description of Artificial Sequence: Synthetic oligonucleotide
uuuuauaacaagagguucauu

SEQ ID NO: 931 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uuuuauaacaagagguucatt

SEQ ID NO: 932 - RNA, 21 nt, Artificial Sequence
  Description of Artificial Sequence: Synthetic oligonucleotide
uccaaauacugguugucgguu

SEQ ID NO: 933 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uccaaauacugguugucggtt

SEQ ID NO: 934 - RNA, 21 nt, Artificial Sequence
  Description of Artificial Sequence: Synthetic oligonucleotide
uauuuuaggaauuccaauguu

SEQ ID NO: 935 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uauuuuaggaauuccaaugtt

SEQ ID NO: 936 - RNA, 21 nt, Artificial Sequence
  Description of Artificial Sequence: Synthetic oligonucleotide
uuuaggaauuccaaugaucuu

SEQ ID NO: 937 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uuuaggaauuccaaugauctt

SEQ ID NO: 938 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uuaaucucuuuacugauautt

SEQ ID NO: 939 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
gauuuuaggaauuccaaugtt

SEQ ID NO: 940 - RNA, 22 nt, Artificial Sequence
  Description of Artificial Sequence: Synthetic oligonucleotide
uaagcauggagcuagcaggcuu

SEQ ID NO: 941 - RNA, 21 nt, Artificial Sequence
  Description of Artificial Sequence: Synthetic oligonucleotide
uaagcauggagcuagcagggu

SEQ ID NO: 942 - RNA, 22 nt, Artificial Sequence
  Description of Artificial Sequence: Synthetic oligonucleotide
aaggacuugagggacucgaagu

SEQ ID NO: 943 - RNA, 21 nt, Artificial Sequence
  Description of Artificial Sequence: Synthetic oligonucleotide
aaggacuugagggacucgaag

SEQ ID NO: 944 - RNA, 19 nt, Artificial Sequence
  Description of Artificial Sequence: Synthetic oligonucleotide
aaggacuugagggacucga

SEQ ID NO: 945 - RNA, 21 nt, Artificial Sequence
  Description of Artificial Sequence: Synthetic oligonucleotide
aggacuugagggacucgaagu

SEQ ID NO: 946 - RNA, 22 nt, Artificial Sequence
  Description of Artificial Sequence: Synthetic oligonucleotide
gaggacuugagggacucgaagu

SEQ ID NO: 947 - RNA, 22 nt, Artificial Sequence
  Description of Artificial Sequence: Synthetic oligonucleotide
aaggacuugagggacucgaagu

SEQ ID NO: 948 - RNA, 23 nt, Artificial Sequence
  Description of Artificial Sequence: Synthetic oligonucleotide
aaggacuugagggacucgaaguu

SEQ ID NO: 949 - RNA, 21 nt, Artificial Sequence
  Description of Artificial Sequence: Synthetic oligonucleotide
aaggacuugagggacucgaag

SEQ ID NO: 950 - RNA, 19 nt, Artificial Sequence
  Description of Artificial Sequence: Synthetic oligonucleotide
aaggacuugagggacucga

SEQ ID NO: 951 - RNA, 22 nt, Artificial Sequence
  Description of Artificial Sequence: Synthetic oligonucleotide
aaggacuugagggacucgaagg

SEQ ID NO: 952 - RNA, 21 nt, Artificial Sequence
  Description of Artificial Sequence: Synthetic oligonucleotide
aaggacuugagggacucgaau

SEQ ID NO: 953 - RNA, 22 nt, Artificial Sequence
  Description of Artificial Sequence: Synthetic oligonucleotide
aaggacuugagggacucgaaga

SEQ ID NO: 954 - RNA, 22 nt, Artificial Sequence
  Description of Artificial Sequence: Synthetic oligonucleotide
aaggacuugagggacucgaagg

SEQ ID NO: 955 - RNA, 23 nt, Artificial Sequence
  Description of Artificial Sequence: Synthetic oligonucleotide
aaggacuugagggacucgaaggu

SEQ ID NO: 956 - RNA, 23 nt, Artificial Sequence
  Description of Artificial Sequence: Synthetic oligonucleotide
aaggacuugagggacucgaagga

SEQ ID NO: 957 - RNA, 21 nt, Artificial Sequence
  Description of Artificial Sequence: Synthetic oligonucleotide
aaggacuugagggacucgaag

SEQ ID NO: 958 - RNA, 22 nt, Artificial Sequence
  Description of Artificial Sequence: Synthetic oligonucleotide
aaggacuugagggacucgaagu

SEQ ID NO: 959 - RNA, 19 nt, Artificial Sequence
  Description of Artificial Sequence: Synthetic oligonucleotide
aaggacuugagggacucga

SEQ ID NO: 960 - RNA, 23 nt, Artificial Sequence
  Description of Artificial Sequence: Synthetic oligonucleotide
aaggacuugagggacucgaagga

SEQ ID NO: 961 - RNA, 22 nt, Artificial Sequence
  Description of Artificial Sequence: Synthetic oligonucleotide
aaggacuugagggacucgaagg

SEQ ID NO: 962 - RNA, 24 nt, Artificial Sequence
  Description of Artificial Sequence: Synthetic oligonucleotide
aaggacuugagggacucgaaggau

SEQ ID NO: 963 - RNA, 25 nt, Artificial Sequence
  Description of Artificial Sequence: Synthetic oligonucleotide
aaggacuugagggacucgaaggauu

SEQ ID NO: 964 - RNA, 21 nt, Artificial Sequence
  Description of Artificial Sequence: Synthetic oligonucleotide
aaggacuugagggacucgaag

SEQ ID NO: 965 - RNA, 24 nt, Artificial Sequence
  Description of Artificial Sequence: Synthetic oligonucleotide
aaggacuugagggacucgaaggaa

SEQ ID NO: 966 - RNA, 23 nt, Artificial Sequence
  Description of Artificial Sequence: Synthetic oligonucleotide
gaugaagugcacacauuggauga

SEQ ID NO: 967 - RNA, 22 nt, Artificial Sequence
  Description of Artificial Sequence: Synthetic oligonucleotide
gaugaacugcacacauuggaug

SEQ ID NO: 968 - RNA, 23 nt, Artificial Sequence
  Description of Artificial Sequence: Synthetic oligonucleotide
gaugaauugcacacaguagauga

SEQ ID NO: 969 - RNA, 24 nt, Artificial Sequence
  Description of Artificial Sequence: Synthetic oligonucleotide
aaggacuugagggacucgaagguu

SEQ ID NO: 970 - RNA, 25 nt, Artificial Sequence
  Description of Artificial Sequence: Synthetic oligonucleotide
aaggacuugagggacucgaagguuu

SEQ ID NO: 971 - RNA, 23 nt, Artificial Sequence
  Description of Artificial Sequence: Synthetic oligonucleotide
aaggacuugagggacucgaaggu

SEQ ID NO: 972 - RNA, 26 nt, Artificial Sequence
  Description of Artificial Sequence: Synthetic oligonucleotide
aaggacuugagggacucgaagguuuu

SEQ ID NO: 973 - RNA, 27 nt, Artificial Sequence
  Description of Artificial Sequence: Synthetic oligonucleotide
aaggacuugagggacucgaagguuuuu

SEQ ID NO: 974 - RNA, 22 nt, Artificial Sequence
  Description of Artificial Sequence: Synthetic oligonucleotide
aaggacuugagggacucgaagg

SEQ ID NO: 975 - RNA, 22 nt, Artificial Sequence
  Description of Artificial Sequence: Synthetic oligonucleotide
uaaggacuugagggacucgaag

SEQ ID NO: 976 - RNA, 21 nt, Artificial Sequence
  Description of Artificial Sequence: Synthetic oligonucleotide
aaggacuugagggacucgaag

SEQ ID NO: 977 - RNA, 22 nt, Artificial Sequence
  Description of Artificial Sequence: Synthetic oligonucleotide
aaggacuugagggacucgaagu

SEQ ID NO: 978 - RNA, 30 nt, Artificial Sequence
  Description of Artificial Sequence: Synthetic oligonucleotide
aaggacuugagggacucgaagacgaguccc

SEQ ID NO: 979 - RNA, 31 nt, Artificial Sequence
  Description of Artificial Sequence: Synthetic oligonucleotide
aaggacuugagggacucgaagacgaguccca

SEQ ID NO: 980 - RNA, 31 nt, Artificial Sequence
  Description of Artificial Sequence: Synthetic oligonucleotide
aaggacuugagggacucgaagacgagucccu

SEQ ID NO: 981 - RNA, 23 nt, Artificial Sequence
  Description of Artificial Sequence: Synthetic oligonucleotide
gaugaagugcacacauuggauac

SEQ ID NO: 982 - RNA, 24 nt, Artificial Sequence
  Description of Artificial Sequence: Synthetic oligonucleotide
gaugaagugcacacauuggauaca

SEQ ID NO: 983 - RNA, 30 nt, Artificial Sequence
  Description of Artificial Sequence: Synthetic oligonucleotide
gaugaagugcacacauuggauacaaugugu

SEQ ID NO: 984 - RNA, 21 nt, Artificial Sequence
  Description of Artificial Sequence: Synthetic oligonucleotide
gaugaagugcacacauuggau

SEQ ID NO: 985 - RNA, 22 nt, Artificial Sequence
  Description of Artificial Sequence: Synthetic oligonucleotide
gaugaagugcacacauuggaua

SEQ ID NO: 986 - RNA, 23 nt, Artificial Sequence
  Description of Artificial Sequence: Synthetic oligonucleotide
gaugaauugcacacaguagauau

SEQ ID NO: 987 - RNA, 25 nt, Artificial Sequence
  Description of Artificial Sequence: Synthetic oligonucleotide
gaugaauugcacacaguagauauac

SEQ ID NO: 988 - RNA, 30 nt, Artificial Sequence
  Description of Artificial Sequence: Synthetic oligonucleotide
gaugaauugcacacaguagauauacugugu

SEQ ID NO: 989 - RNA, 24 nt, Artificial Sequence
  Description of Artificial Sequence: Synthetic oligonucleotide
gaugaauugcacacaguagauaua

SEQ ID NO: 990 - RNA, 24 nt, Artificial Sequence
  Description of Artificial Sequence: Synthetic oligonucleotide
augaauugcacacaguagauauac

SEQ ID NO: 991 - RNA, 22 nt, Artificial Sequence
  Description of Artificial Sequence: Synthetic oligonucleotide
gaugaauugcacacaguagaua

SEQ ID NO: 992 - RNA, 30 nt, Artificial Sequence; identical to SEQ ID NO: 988
  Description of Artificial Sequence: Synthetic oligonucleotide

SEQ ID NO: 993 - RNA, 20 nt, Artificial Sequence
  Description of Artificial Sequence: Synthetic oligonucleotide
uacaacgagacugaauugcu

SEQ ID NO: 994 - RNA, 20 nt, Artificial Sequence
  Description of Artificial Sequence: Synthetic oligonucleotide
acaacgagacugaauugcuu

SEQ ID NO: 995 - RNA, 22 nt, Artificial Sequence
  Description of Artificial Sequence: Synthetic oligonucleotide
uccggucacaacauugugguuc

SEQ ID NO: 996 - RNA, 20 nt, Artificial Sequence
  Description of Artificial Sequence: Synthetic oligonucleotide
uccggucacaacauuguggu

SEQ ID NO: 997 - RNA, 18 nt, Artificial Sequence
  Description of Artificial Sequence: Synthetic oligonucleotide
uccggucacaacauugug

SEQ ID NO: 998 - RNA, 20 nt, Artificial Sequence
  Description of Artificial Sequence: Synthetic oligonucleotide
ccggucacaacauugugguu

SEQ ID NO: 999 - RNA, 20 nt, Artificial Sequence
  Description of Artificial Sequence: Synthetic oligonucleotide
uuuuauaacaagagguucau

SEQ ID NO: 1000 - RNA, 20 nt, Artificial Sequence
  Description of Artificial Sequence: Synthetic oligonucleotide
uuuauaacaagagguucauu

SEQ ID NO: 1001 - RNA, 20 nt, Artificial Sequence
  Description of Artificial Sequence: Synthetic oligonucleotide
uaagcauggagcuagcaggu

SEQ ID NO: 1002 - RNA, 20 nt, Artificial Sequence
  Description of Artificial Sequence: Synthetic oligonucleotide
aagcauggagcuagcagguu

SEQ ID NO: 1003 - RNA, 20 nt, Artificial Sequence
  Description of Artificial Sequence: Synthetic oligonucleotide
ccaaauacugguugucgguu

SEQ ID NO: 1004 - RNA, 22 nt, Artificial Sequence
  Description of Artificial Sequence: Synthetic oligonucleotide
uacaacgagacugaauugcuuu

SEQ ID NO: 1005 - RNA, 22 nt, Artificial Sequence
  Description of Artificial Sequence: Synthetic oligonucleotide
uaacgucaguucauaaaccuuu

SEQ ID NO: 1006 - RNA, 22 nt, Artificial Sequence
  Description of Artificial Sequence: Synthetic oligonucleotide
guccggucacaacauugugguu

SEQ ID NO: 1007 - RNA, 23 nt, Artificial Sequence
  Description of Artificial Sequence: Synthetic oligonucleotide
uccggucacaacauugugguuug

SEQ ID NO: 1008 - RNA, 22 nt, Artificial Sequence
  Description of Artificial Sequence: Synthetic oligonucleotide
uccggucacaacauugugguuu

SEQ ID NO: 1009 - RNA, 19 nt, Artificial Sequence
  Description of Artificial Sequence: Synthetic oligonucleotide
uccggucacaacauugugg

SEQ ID NO: 1010 - RNA, 22 nt, Artificial Sequence
  Description of Artificial Sequence: Synthetic oligonucleotide
uaagcauggagcuagcagguuu

SEQ ID NO: 1011 - RNA, 21 nt, Artificial Sequence
  Description of Artificial Sequence: Synthetic oligonucleotide
aagcauggagcuagcagguuu

SEQ ID NO: 1012 - RNA, 22 nt, Artificial Sequence
  Description of Artificial Sequence: Synthetic oligonucleotide
uccaaauacugguugucgguuu

SEQ ID NO: 1013 - RNA, 21 nt, Artificial Sequence
  Description of Artificial Sequence: Synthetic oligonucleotide
ccaaauacugguugucgguuu

SEQ ID NO: 1014 - RNA, 21 nt, Artificial Sequence
  Description of Artificial Sequence: Synthetic oligonucleotide
guuuaugaacugaucuuaccc

SEQ ID NO: 1015 - RNA, 21 nt, Artificial Sequence
  Description of Artificial Sequence: Synthetic oligonucleotide
guguuagacgguacugauccc

SEQ ID NO: 1016 - RNA, 21 nt, Artificial Sequence
  Description of Artificial Sequence: Synthetic oligonucleotide
ccugcuagcuccaugcuuccc

SEQ ID NO: 1017 - RNA, 21 nt, Artificial Sequence
  Description of Artificial Sequence: Synthetic oligonucleotide
guuuaugaacugaucuuagcc

SEQ ID NO: 1018 - RNA, 21 nt, Artificial Sequence
  Description of Artificial Sequence: Synthetic oligonucleotide
guguuagacgguacugaugcc

SEQ ID NO: 1019 - RNA, 21 nt, Artificial Sequence
  Description of Artificial Sequence: Synthetic oligonucleotide
ccugcuagcuccaugcuugcc

SEQ ID NO: 1020 - RNA, 21 nt, Artificial Sequence
  Description of Artificial Sequence: Synthetic oligonucleotide
guuuaugaagugaucuuaacc

SEQ ID NO: 1021 - RNA, 21 nt, Artificial Sequence
  Description of Artificial Sequence: Synthetic oligonucleotide
guguuagaccguacugauacc

SEQ ID NO: 1022 - RNA, 21 nt, Artificial Sequence
  Description of Artificial Sequence: Synthetic oligonucleotide
ccugcuagcaccaugcuuacc

SEQ ID NO: 1023 - RNA, 21 nt, Artificial Sequence
  Description of Artificial Sequence: Synthetic oligonucleotide
guuuaugaacugaucuuaacc

SEQ ID NO: 1024 - RNA, 21 nt, Artificial Sequence
  Description of Artificial Sequence: Synthetic oligonucleotide
guguuagacgguacugauacc

SEQ ID NO: 1025 - RNA, 21 nt, Artificial Sequence
  Description of Artificial Sequence: Synthetic oligonucleotide
ccugcuagcuccaugcuuacc

SEQ ID NO: 1026 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
ccugcuagcuccaugcuuatt

SEQ ID NO: 1027 - RNA, 21 nt, Artificial Sequence
  Description of Artificial Sequence: Synthetic oligonucleotide
guuuaugaacugaucuugccc

SEQ ID NO: 1028 - RNA, 21 nt, Artificial Sequence
  Description of Artificial Sequence: Synthetic oligonucleotide
guuuaugaacugaucuuggcc

SEQ ID NO: 1029 - RNA, 21 nt, Artificial Sequence
  Description of Artificial Sequence: Synthetic oligonucleotide
guuuaugaacugaucuugacc

SEQ ID NO: 1030 - RNA, 21 nt, Artificial Sequence
  Description of Artificial Sequence: Synthetic oligonucleotide
gcaauucagucucguuguccc

SEQ ID NO: 1031 - RNA, 21 nt, Artificial Sequence
  Description of Artificial Sequence: Synthetic oligonucleotide
uccagguuuaugaacugaccc

SEQ ID NO: 1032 - RNA, 21 nt, Artificial Sequence
  Description of Artificial Sequence: Synthetic oligonucleotide
gguuuaugaacugacguuccc

SEQ ID NO: 1033 - RNA, 21 nt, Artificial Sequence
  Description of Artificial Sequence: Synthetic oligonucleotide
ccacaauguugugacuggccc

SEQ ID NO: 1034 - RNA, 21 nt, Artificial Sequence
  Description of Artificial Sequence: Synthetic oligonucleotide
gucacaaagaaccguguaccc

SEQ ID NO: 1035 - RNA, 21 nt, Artificial Sequence
  Description of Artificial Sequence: Synthetic oligonucleotide
ugaaccucuuguuauaaaccc

SEQ ID NO: 1036 - RNA, 21 nt, Artificial Sequence
  Description of Artificial Sequence: Synthetic oligonucleotide
ccgacaaccaguauuuggccc

SEQ ID NO: 1037 - RNA, 21 nt, Artificial Sequence
  Description of Artificial Sequence: Synthetic oligonucleotide
gcaauucagucucguugugcc

SEQ ID NO: 1038 - RNA, 21 nt, Artificial Sequence
  Description of Artificial Sequence: Synthetic oligonucleotide
uccagguuuaugaacugagcc

SEQ ID NO: 1039 - RNA, 21 nt, Artificial Sequence
  Description of Artificial Sequence: Synthetic oligonucleotide
gguuuaugaacugacguugcc

SEQ ID NO: 1040 - RNA, 21 nt, Artificial Sequence
  Description of Artificial Sequence: Synthetic oligonucleotide
ccacaauguugugacugggcc

SEQ ID NO: 1041 - RNA, 21 nt, Artificial Sequence
  Description of Artificial Sequence: Synthetic oligonucleotide
gucacaaagaaccguguagcc

SEQ ID NO: 1042 - RNA, 21 nt, Artificial Sequence
  Description of Artificial Sequence: Synthetic oligonucleotide
ugaaccucuuguuauaaagcc

SEQ ID NO: 1043 - RNA, 21 nt, Artificial Sequence
  Description of Artificial Sequence: Synthetic oligonucleotide
ccgacaaccaguauuugggcc

SEQ ID NO: 1044 - RNA, 21 nt, Artificial Sequence
  Description of Artificial Sequence: Synthetic oligonucleotide
gcaauucagucucguuguacc

SEQ ID NO: 1045 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
gcaauucagucucguuguatt

SEQ ID NO: 1046 - RNA, 21 nt, Artificial Sequence
  Description of Artificial Sequence: Synthetic oligonucleotide
uccagguuuaugaacugaacc

SEQ ID NO: 1047 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
uccagguuuaugaacugaatt

SEQ ID NO: 1048 - RNA, 21 nt, Artificial Sequence
  Description of Artificial Sequence: Synthetic oligonucleotide
gguuuaugaacugacguuacc

SEQ ID NO: 1049 - RNA, 21 nt, Artificial Sequence
  Description of Artificial Sequence: Synthetic oligonucleotide
ccacaauguugugacuggacc

SEQ ID NO: 1050 - RNA, 21 nt, Artificial Sequence
  Description of Artificial Sequence: Synthetic oligonucleotide
gucacaaagaaccguguaacc

SEQ ID NO: 1051 - RNA, 21 nt, Artificial Sequence
  Description of Artificial Sequence: Synthetic oligonucleotide
ugaaccucuuguuauaaaacc

SEQ ID NO: 1052 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
ugaaccucuuguuauaaaatt

SEQ ID NO: 1053 - RNA, 21 nt, Artificial Sequence
  Description of Artificial Sequence: Synthetic oligonucleotide
ccgacaaccaguauuuggacc

SEQ ID NO: 1054 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
ccgacaaccaguauuuggatt

SEQ ID NO: 1055 - RNA, 21 nt, Artificial Sequence
  Description of Artificial Sequence: Synthetic oligonucleotide
gcaauucagacucguuguacc

SEQ ID NO: 1056 - RNA, 21 nt, Artificial Sequence
  Description of Artificial Sequence: Synthetic oligonucleotide
uccagguuuuugaacugaacc

SEQ ID NO: 1057 - RNA, 21 nt, Artificial Sequence
  Description of Artificial Sequence: Synthetic oligonucleotide
gguuuaugaucugacguuacc

SEQ ID NO: 1058 - RNA, 21 nt, Artificial Sequence
  Description of Artificial Sequence: Synthetic oligonucleotide
ccacaauguagugacuggacc

SEQ ID NO: 1059 - RNA, 21 nt, Artificial Sequence
  Description of Artificial Sequence: Synthetic oligonucleotide
gucacaaaguaccguguaacc

SEQ ID NO: 1060 - RNA, 21 nt, Artificial Sequence
  Description of Artificial Sequence: Synthetic oligonucleotide
ugaaccucuaguuauaaaacc

SEQ ID NO: 1061 - RNA, 21 nt, Artificial Sequence
  Description of Artificial Sequence: Synthetic oligonucleotide
ccgacaaccuguauuuggacc

SEQ ID NO: 1062 - RNA, 21 nt, Artificial Sequence
  Description of Artificial Sequence: Synthetic oligonucleotide
cauuggaauuccuaaaauucc

SEQ ID NO: 1063 - RNA, 21 nt, Artificial Sequence
  Description of Artificial Sequence: Synthetic oligonucleotide
gaucauuggaauuccuaaucc

SEQ ID NO: 1064 - RNA, 21 nt, Artificial Sequence
  Description of Artificial Sequence: Synthetic oligonucleotide
cauuggaauuccuaaaaugcc

SEQ ID NO: 1065 - RNA, 21 nt, Artificial Sequence
  Description of Artificial Sequence: Synthetic oligonucleotide
gaucauuggaauuccuaagcc

SEQ ID NO: 1066 - RNA, 21 nt, Artificial Sequence
  Description of Artificial Sequence: Synthetic oligonucleotide
cauuggaauuccuaaaauacc

SEQ ID NO: 1067 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
cauuggaauuccuaaaauatt

SEQ ID NO: 1068 - RNA, 21 nt, Artificial Sequence
  Description of Artificial Sequence: Synthetic oligonucleotide
gaucauuggaauuccuaaacc

SEQ ID NO: 1069 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
gaucauuggaauuccuaaatt

SEQ ID NO: 1070 - RNA, 21 nt, Artificial Sequence
  Description of Artificial Sequence: Synthetic oligonucleotide
cauuggaauaccuaaaauacc

SEQ ID NO: 1071 - RNA, 21 nt, Artificial Sequence
  Description of Artificial Sequence: Synthetic oligonucleotide
gaucauugguauuccuaaacc

SEQ ID NO: 1072 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
guuuaugaacugacguuaatt

SEQ ID NO: 1073 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
guguuagacgguaccgacatt

SEQ ID NO: 1074 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
auaucaguaaagagauuaatt

SEQ ID NO: 1075 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
gguuuaugaacugacguuatt

SEQ ID NO: 1076 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
ccacaauguugugaccggatt

SEQ ID NO: 1077 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
gucacaaagaaccgugcaatt

SEQ ID NO: 1078 - DNA, 21 bp, Artificial Sequence
  Description of Artificial Sequence: Synthetic oligonucleotide; Description of Combined DNA/RNA Molecule: Synthetic oligonucleotide
  misc_feature (20)..(21): TT is a deoxythymidine dinucleotide
cauuggaauuccuaaaauctt

SEQ ID NO: 1079 - RNA, 21 nt, Artificial Sequence
  Description of Artificial Sequence: Synthetic oligonucleotide
ccugcuagcuccaugcuugcu

SEQ ID NO: 1080 - RNA, 21 nt, Artificial Sequence
  Description of Artificial Sequence: Synthetic oligonucleotide
ccugcuagcuccaugcuugau

SEQ ID NO: 1081 - RNA, 21 nt, Artificial Sequence
  Description of Artificial Sequence: Synthetic oligonucleotide
ccugcuagcuccaugcuuauu

SEQ ID NO: 1082 - RNA, 21 nt, Artificial Sequence
  Description of Artificial Sequence: Synthetic oligonucleotide
ccugcuagcuccaugcuuguu

SEQ ID NO: 1083 - RNA, 20 nt, Artificial Sequence
  Description of Artificial Sequence: Synthetic oligonucleotide
uucgagucccucaaguagcu

SEQ ID NO: 1084 - RNA, 22 nt, Artificial Sequence
  Description of Artificial Sequence: Synthetic oligonucleotide
uucgagucccucaaguagcuuu

SEQ ID NO: 1085 - RNA, 22 nt, Artificial Sequence
  Description of Artificial Sequence: Synthetic oligonucleotide
ucgagucccucaaguccauucu

SEQ ID NO: 1086 - RNA, 21 nt, Artificial Sequence
  Description of Artificial Sequence: Synthetic oligonucleotide
uuccaguccaucaagucaauu

SEQ ID NO: 1087 - RNA, 22 nt, Artificial Sequence
  Description of Artificial Sequence: Synthetic oligonucleotide
uuccgagucuaaaaguccuugg

SEQ ID NO: 1088 - RNA, 23 nt, Artificial Sequence
  Description of Artificial Sequence: Synthetic oligonucleotide
uuccgagucuaaaaguccuuggc

SEQ ID NO: 1089 - RNA, 23 nt, Artificial Sequence
  Description of Artificial Sequence: Synthetic oligonucleotide
cuuccgagucuaaaaguccuugg

SEQ ID NO: 1090 - RNA, 23 nt, Artificial Sequence
  Description of Artificial Sequence: Synthetic oligonucleotide
uuccgagucuaaaaguccuuggu

SEQ ID NO: 1091 - RNA, 24 nt, Artificial Sequence
  Description of Artificial Sequence: Synthetic oligonucleotide
uuccgagucuaaaaguccuuggcu

SEQ ID NO: 1092 - RNA, 23 nt, Artificial Sequence
  Description of Artificial Sequence: Synthetic oligonucleotide
uccaaugugaaacuucaucggcu

SEQ ID NO: 1093 - RNA, 22 nt, Artificial Sequence
  Description of Artificial Sequence: Synthetic oligonucleotide
uccaaugugaaacuucaucggc

SEQ ID NO: 1094 - RNA, 22 nt, Artificial Sequence
  Description of Artificial Sequence: Synthetic oligonucleotide
auccaaugugaaacuucaucgu

SEQ ID NO: 1095 - RNA, 23 nt, Artificial Sequence
  Description of Artificial Sequence: Synthetic oligonucleotide
auccaaugugaaacuucaucggu

SEQ ID NO: 1096 - RNA, 22 nt, Artificial Sequence
  Description of Artificial Sequence: Synthetic oligonucleotide
uccaaugugaaacuucaucggu

SEQ ID NO: 1097 - RNA, 24 nt, Artificial Sequence
  Description of Artificial Sequence: Synthetic oligonucleotide
uccaaugugaaacuucaucggcuu

SEQ ID NO: 1098 - RNA, 22 nt, Artificial Sequence
  Description of Artificial Sequence: Synthetic oligonucleotide
aucuacugugaaaauucaucgg

SEQ ID NO: 1099 - RNA, 21 nt, Artificial Sequence
  Description of Artificial Sequence: Synthetic oligonucleotide
ucuacugugaaaauucaucgg

SEQ ID NO: 1100 - RNA, 22 nt, Artificial Sequence
  Description of Artificial Sequence: Synthetic oligonucleotide
ucuacugugaaaauucaucggc

SEQ ID NO: 1101 - RNA, 23 nt, Artificial Sequence
  Description of Artificial Sequence: Synthetic oligonucleotide
aucuacugugaaaauucaucggu

SEQ ID NO: 1102 - RNA, 22 nt, Artificial Sequence
  Description of Artificial Sequence: Synthetic oligonucleotide
ucuacugugaaaauucaucggu

SEQ ID NO: 1103 - RNA, 23 nt, Artificial Sequence
  Description of Artificial Sequence: Synthetic oligonucleotide
ucuacugugaaaauucaucggcu

SEQ ID NO: 1104 - RNA, 22 nt, Artificial Sequence
  Description of Artificial Sequence: Synthetic oligonucleotide
ccuucgguccucaaguccuuca

SEQ ID NO: 1105 - RNA, 24 nt, Artificial Sequence
  Description of Artificial Sequence: Synthetic oligonucleotide
uucgaguccaucaaauccuauagu

SEQ ID NO: 1106 - RNA, 21 nt, Artificial Sequence
  Description of Artificial Sequence: Synthetic oligonucleotide
uacaaugugugcacuucauau

SEQ ID NO: 1107 - RNA, 23 nt, Artificial Sequence
  Description of Artificial Sequence: Synthetic oligonucleotide
uauacugugugcaauucauuucu

SEQ ID NO: 1108 - RNA, 20 nt, Artificial Sequence
  Description of Artificial Sequence: Synthetic oligonucleotide
gcaauucagucucguugucc

SEQ ID NO: 1109 - RNA, 19 nt, Artificial Sequence
  Description of Artificial Sequence: Synthetic oligonucleotide
gcaauucagucucguuguc

SEQ ID NO: 1110 - RNA, 20 nt, Artificial Sequence
  Description of Artificial Sequence: Synthetic oligonucleotide
caauucagucucguuguccc

SEQ ID NO: 1111 - RNA, 19 nt, Homo sapiens
caauucagucucguugucc

SEQ ID NO: 1112 - RNA, 20 nt, Artificial Sequence
  Description of Artificial Sequence: Synthetic oligonucleotide
gcaauucagucucguugugc

SEQ ID NO: 1113 - RNA, 20 nt, Artificial Sequence
  Description of Artificial Sequence: Synthetic oligonucleotide
caauucagucucguugugcc

SEQ ID NO: 1114 - RNA, 22 nt, Artificial Sequence
  Description of Artificial Sequence: Synthetic oligonucleotide
ccacaauguugugacugggccu

SEQ ID NO: 1115 - RNA, 20 nt, Artificial Sequence
  Description of Artificial Sequence: Synthetic oligonucleotide
ccacaauguugugacugggc

SEQ ID NO: 1116 - RNA, 20 nt, Artificial Sequence
  Description of Artificial Sequence: Synthetic oligonucleotide
cacaauguugugacugggcc

SEQ ID NO: 1117 - RNA, 22 nt, Artificial Sequence
  Description of Artificial Sequence: Synthetic oligonucleotide
ugaaccucuuguuauaaagccu

SEQ ID NO: 1118 - RNA, 20 nt, Artificial Sequence
  Description of Artificial Sequence: Synthetic oligonucleotide
ugaaccucuuguuauaaagc

SEQ ID NO: 1119 - RNA, 20 nt, Artificial Sequence
  Description of Artificial Sequence: Synthetic oligonucleotide
gaaccucuuguuauaaagcc

SEQ ID NO: 1120 - RNA, 22 nt, Artificial Sequence
  Description of Artificial Sequence: Synthetic oligonucleotide
ccugcuagcuccaugcuugccu

SEQ ID NO: 1121 - RNA, 20 nt, Artificial Sequence
  Description of Artificial Sequence: Synthetic oligonucleotide
ccugcuagcuccaugcuugc

SEQ ID NO: 1122 - RNA, 19 nt, Artificial Sequence
  Description of Artificial Sequence: Synthetic oligonucleotide
ccugcuagcuccaugcuug

SEQ ID NO: 1123 - RNA, 20 nt, Artificial Sequence
  Description of Artificial Sequence: Synthetic oligonucleotide
cugcuagcuccaugcuugcc

SEQ ID NO: 1124 - RNA, 22 nt, Artificial Sequence
  Description of Artificial Sequence: Synthetic oligonucleotide
ccgacaaccaguauuugggccu

SEQ ID NO: 1125 - RNA, 20 nt, Artificial Sequence
  Description of Artificial Sequence: Synthetic oligonucleotide
ccgacaaccaguauuugggc

SEQ ID NO: 1126 - RNA, 19 nt, Artificial Sequence
  Description of Artificial Sequence: Synthetic oligonucleotide
ccgacaaccaguauuuggg

SEQ ID NO: 1127 - RNA, 20 nt, Artificial Sequence
  Description of Artificial Sequence: Synthetic oligonucleotide
cgacaaccaguauuugggcc

SEQ ID NO: 1128 - RNA, 19 nt, Artificial Sequence
  Description of Artificial Sequence: Synthetic oligonucleotide
cgacaaccaguauuugggc

SEQ ID NO: 1129 - RNA, 22 nt, Artificial Sequence
  Description of Artificial Sequence: Synthetic oligonucleotide
gcaauucagucucguuguaccu

SEQ ID NO: 1130 - RNA, 20 nt, Artificial Sequence
  Description of Artificial Sequence: Synthetic oligonucleotide
gcaauucagucucguuguac

SEQ ID NO: 1131 - RNA, 19 nt, Artificial Sequence
  Description of Artificial Sequence: Synthetic oligonucleotide
gcaauucagucucguugua

SEQ ID NO: 1132 - RNA, 20 nt, Artificial Sequence
  Description of Artificial Sequence: Synthetic oligonucleotide
caauucagucucguuguacc

SEQ ID NO: 1133 - RNA, 22 nt, Artificial Sequence
  Description of Artificial Sequence: Synthetic oligonucleotide
gcaauucagacucguuguaccu

SEQ ID NO: 1134 - RNA, 20 nt, Artificial Sequence
  Description of Artificial Sequence: Synthetic oligonucleotide
gcaauucagacucguuguac

SEQ ID NO: 1135 - RNA, 19 nt, Artificial Sequence
  Description of Artificial Sequence: Synthetic oligonucleotide
gcaauucagacucguugua

SEQ ID NO: 1136 - RNA, 20 nt, Artificial Sequence
  Description of Artificial Sequence: Synthetic oligonucleotide
caauucagacucguuguacc

SEQ ID NO: 1137 - RNA, 22 nt, Artificial Sequence
  Description of Artificial Sequence: Synthetic oligonucleotide
agcaauucagucucguuguacc

SEQ ID NO: 1138 - RNA, 21 nt, Artificial Sequence
  Description of Artificial Sequence: Synthetic oligonucleotide
agcaauucagucucguuguac

SEQ ID NO: 1139 - RNA, 21 nt, Artificial Sequence
  Description of Artificial Sequence: Synthetic oligonucleotide
agguuuaugaacugacguuac

SEQ ID NO: 1140 - RNA, 22 nt, Artificial Sequence
  Description of Artificial Sequence: Synthetic oligonucleotide
agguuuaugaacugacguuacc

SEQ ID NO: 1141 - RNA, 21 nt, Artificial Sequence
  Description of Artificial Sequence: Synthetic oligonucleotide
accacaauguugugacuggac

SEQ ID NO: 1142 - RNA, 22 nt, Artificial Sequence
  Description of Artificial Sequence: Synthetic oligonucleotide
accacaauguugugacuggacc

SEQ ID NO: 1143 - RNA, 23 nt, Artificial Sequence
  Description of Artificial Sequence: Synthetic oligonucleotide
ccacaauguugugacuggaccgu

SEQ ID NO: 1144 - RNA, 22 nt, Artificial Sequence
  Description of Artificial Sequence: Synthetic oligonucleotide
ccacaauguugugacuggaccg

SEQ ID NO: 1145 - RNA, 20 nt, Artificial Sequence
  Description of Artificial Sequence: Synthetic oligonucleotide
ccacaauguugugacuggac

SEQ ID NO: 1146 - RNA, 20 nt, Artificial Sequence
  Description of Artificial Sequence: Synthetic oligonucleotide
cacaauguugugacuggacc

SEQ ID NO: 1147 - RNA, 22 nt, Artificial Sequence
  Description of Artificial Sequence: Synthetic oligonucleotide
accugcuagcuccaugcuuccc

SEQ ID NO: 1148 - RNA, 21 nt, Artificial Sequence
  Description of Artificial Sequence: Synthetic oligonucleotide
accugcuagcuccaugcuucc

SEQ ID NO: 1149 - RNA, 20 nt, Artificial Sequence
  Description of Artificial Sequence: Synthetic oligonucleotide
accugcuagcuccaugcuuc

SEQ ID NO: 1150 - RNA, 20 nt, Artificial Sequence
  Description of Artificial Sequence: Synthetic oligonucleotide
ccugcuagcuccaugcuucc

SEQ ID NO: 1151 - RNA, 19 nt, Artificial Sequence
  Description of Artificial Sequence: Synthetic oligonucleotide
ccugcuagcuccaugcuuc

SEQ ID NO: 1152 - RNA, 20 nt, Artificial Sequence
  Description of Artificial Sequence: Synthetic oligonucleotide
cugcuagcuccaugcuuccc

SEQ ID NO: 1153 - RNA, 19 nt, Artificial Sequence
  Description of Artificial Sequence: Synthetic oligonucleotide
cugcuagcuccaugcuucc

SEQ ID NO: 1154 - RNA, 22 nt, Artificial Sequence
  Description of Artificial Sequence: Synthetic oligonucleotide
accgacaaccaguauuuggacc

SEQ ID NO: 1155 - RNA, 21 nt, Artificial Sequence
  Description of Artificial Sequence: Synthetic oligonucleotide
accgacaaccaguauuuggac

SEQ ID NO: 1156 - RNA, 23 nt, Artificial Sequence
  Description of Artificial Sequence: Synthetic oligonucleotide
ccgacaaccaguauuuggaccgu

SEQ ID NO: 1157 - RNA, 23 nt, Artificial Sequence
  Description of Artificial Sequence: Synthetic oligonucleotide
ccgacaaccaguauuuggaccgu

SEQ ID NO: 1158 - RNA, 20 nt, Artificial Sequence
  Description of Artificial Sequence: Synthetic oligonucleotide
ccgacaaccaguauuuggac

SEQ ID NO: 1159 - RNA, 20 nt, Artificial Sequence
  Description of Artificial Sequence: Synthetic oligonucleotide
cgacaaccaguauuuggacc

SEQ ID NO: 1160 - RNA, 21 nt, Artificial Sequence
  Description of Artificial Sequence: Synthetic oligonucleotide
ccugcuagcaccgugcuuacc

SEQ ID NO: 1161 - DNA, 54 bp, Artificial Sequence
  Description of Artificial Sequence: Synthetic oligonucleotide
gtgctgggcggggggcggcgggccctcccgcagaacaccatgcgctcttcggaa

SEQ ID NO: 1162 - DNA, 100 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccaga

SEQ ID NO: 1163 - DNA, 54 bp, Artificial Sequence
  Description of Artificial Sequence: Synthetic oligonucleotide
gtgctgggcggggggcggcgggccctcccgcagaacaccatgcgctccacggaa

SEQ ID NO: 1164 - DNA, 35 bp, Artificial Sequence
  Description of Artificial Sequence: Synthetic oligonucleotide
gggccctcccgcagaacaccatgcgctccacggaa

SEQ ID NO: 1165 - DNA, 30 bp, Artificial Sequence
  Description of Artificial Sequence: Synthetic oligonucleotide
ctcccgcagaacaccatgcgctccacggaa

SEQ ID NO: 1166 - DNA, 55 bp, Artificial Sequence
  Description of Artificial Sequence: Synthetic oligonucleotide
gtgctgggcggggggcggcgggccctcccgcagaacaccatgcgctccacggaag

SEQ ID NO: 1167 - DNA, 54 bp, Artificial Sequence
  Description of Artificial Sequence: Synthetic oligonucleotide
gtgctgggcggggggcggcgggccctcccgcagaacaccatgcgctcctcggaa

SEQ ID NO: 1168 - DNA, 10 bp, Artificial Sequence
  Description of Artificial Sequence: Synthetic oligonucleotide
tgtgacctgg

SEQ ID NO: 1169 - DNA, 10 bp, Artificial Sequence
  Description of Artificial Sequence: Synthetic oligonucleotide
tgtgatttgg

SEQ ID NO: 1170 - DNA, 18 bp, Artificial Sequence
  Description of Artificial Sequence: Synthetic oligonucleotide
gtctgcacctgtcactag

SEQ ID NO: 1171 - DNA, 10 bp, Artificial Sequence
  Description of Artificial Sequence: Synthetic oligonucleotide
gtgacccaag

SEQ ID NO: 1172 - DNA, 15 bp, Artificial Sequence
  Description of Artificial Sequence: Synthetic oligonucleotide
gtggccactgagaag

SEQ ID NO: 1173 - DNA, 10 bp, Artificial Sequence
  Description of Artificial Sequence: Synthetic oligonucleotide
gtgacccaat

SEQ ID NO: 1174 - DNA, 10 bp, Artificial Sequence
  Description of Artificial Sequence: Synthetic oligonucleotide
gtgacccaac

SEQ ID NO: 1175 - DNA, 15 bp, Artificial Sequence
  Description of Artificial Sequence: Synthetic oligonucleotide
gtggccactgagaaa

SEQ ID NO: 1176 - protein, 7 aa, Artificial Sequence
  Description of Artificial Sequence: Synthetic polypeptide
QAVRTSL

SEQ ID NO: 1177 - protein, 7 aa, Artificial Sequence
  Description of Artificial Sequence: Synthetic polypeptide
LAKERLS

SEQ ID NO: 1178 - DNA, 52 bp, Artificial Sequence
  Description of Artificial Sequence: Synthetic oligonucleotide
ctgaggagcgccttgacagcagccatgggagggccgccccctacctcagtga

SEQ ID NO: 1179 - DNA, 52 bp, Artificial Sequence
  Description of Artificial Sequence: Synthetic oligonucleotide
ctgtggagcgccttgacagcagccatgggagggccgccccctacctcagtga

SEQ ID NO: 1180 - DNA, 100 bp, Artificial Sequence
  Description of Artificial Sequence: Synthetic oligonucleotide
tggccgtgtagtgctacccagcgctggctgcctcctcagcattgcaattcctctcccatctgggcaccagtcagctaccctggtgggaatctgggtagcc

SEQ ID NO: 1181 - DNA, 35 bp, Artificial Sequence
  Description of Artificial Sequence: Synthetic oligonucleotide
ctgaggagcgccttgacagcagccatgggagggcc

SEQ ID NO: 1182 - DNA, 52 bp, Artificial Sequence
  Description of Artificial Sequence: Synthetic oligonucleotide
ctgcggagcgccttgacagcagccatgggagggccgccccctacctcagtga

SEQ ID NO: 1183 - DNA, 158 bp, Artificial Sequence
  Description of Artificial Sequence: Synthetic oligonucleotide
gtgctgggcggggggcggcgggccctcccgcagaacaccatgcgctcttcggaatccaggtttatgaactgaccctgtgacctggttcagttcataaacctggattctgaggagcgccttgacagcagccatgggagggccgccccctacctcagtga

SEQ ID NO: 1184 - DNA, 158 bp, Artificial Sequence
  Description of Artificial Sequence: Synthetic oligonucleotide
gtgctgggcggggggcggcgggccctcccgcagaacaccatgcgctcttcggaatccaggtttatgaactgagcctgtgacctggttcagttcataaacctggattctgaggagcgccttgacagcagccatgggagggccgccccctacctcagtga

SEQ ID NO: 1185 - DNA, 158 bp, Artificial Sequence
  Description of Artificial Sequence: Synthetic oligonucleotide
gtgctgggcggggggcggcgggccctcccgcagaacaccatgcgctcttcggaatccaggtttatgaactgaacctgtgatttggttcagttcataaacctggattctgaggagcgccttgacagcagccatgggagggccgccccctacctcagtga

SEQ ID NO: 1186 - DNA, 158 bp, Artificial Sequence
  Description of Artificial Sequence: Synthetic oligonucleotide
gtgctgggcggggggcggcgggccctcccgcagaacaccatgcgctcttcggaatccaggtttttgaactgaacctgtgacctggttcagttcataaacctggattctgtggagcgccttgacagcagccatgggagggccgccccctacctcagtga

SEQ ID NO: 1187 - DNA, 158 bp, Artificial Sequence
  Description of Artificial Sequence: Synthetic oligonucleotide
gtgctgggcggggggcggcgggccctcccgcagaacaccatgcgctcttcggaatccaggtttatgaactgaacctgtgacctggttcagttcataaacctggattctgtggagcgccttgacagcagccatgggagggccgccccctacctcagtga

SEQ ID NO: 1188 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagatccaggtttatgaactgaaccgtctgcacctgtcactagtgtcggtaccgtctaacactttggccgtgtagtgctacccagcgctggctgcctcctcagcattgcaattcctctcccatctgggcaccagtcagctaccctggtgggaatctgggtagcc

SEQ ID NO: 1189 - DNA, 158 bp, Artificial Sequence
  Description of Artificial Sequence: Synthetic oligonucleotide
gtgctgggcggggggcggcgggccctcccgcagaacaccatgcgctcttcggaaggtttatgaactgacgttccctgtgacctggtaacgtcagttcataaaccttctgaggagcgccttgacagcagccatgggagggccgccccctacctcagtga

SEQ ID NO: 1190 - DNA, 158 bp, Artificial Sequence
  Description of Artificial Sequence: Synthetic oligonucleotide
gtgctgggcggggggcggcgggccctcccgcagaacaccatgcgctcttcggaaggtttatgaactgacgttgcctgtgacctggtaacgtcagttcataaaccttctgaggagcgccttgacagcagccatgggagggccgccccctacctcagtga

SEQ ID NO: 1191 - DNA, 158 bp, Artificial Sequence
  Description of Artificial Sequence: Synthetic oligonucleotide
gtgctgggcggggggcggcgggccctcccgcagaacaccatgcgctcttcggaaggtttatgaactgacgttacctgtgatttggtaacgtcagttcataaaccttctgaggagcgccttgacagcagccatgggagggccgccccctacctcagtga

SEQ ID NO: 1192 - DNA, 158 bp, Artificial Sequence
  Description of Artificial Sequence: Synthetic oligonucleotide
gtgctgggcggggggcggcgggccctcccgcagaacaccatgcgctcttcggaaggtttatgatctgacgttacctgtgacctggtaacgtcagttcataaaccttctgtggagcgccttgacagcagccatgggagggccgccccctacctcagtga

SEQ ID NO: 1193 - DNA, 158 bp, Artificial Sequence
  Description of Artificial Sequence: Synthetic oligonucleotide
gtgctgggcggggggcggcgggccctcccgcagaacaccatgcgctcttcggaaggtttatgaactgacgttacctgtgacctggtaacgtcagttcataaaccttctgtggagcgccttgacagcagccatgggagggccgccccctacctcagtga

SEQ ID NO: 1194 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagaggtttatgaactgacgttaccgtctgcacctgtcactagtaacgtcagttcataaacctttggccgtgtagtgctacccagcgctggctgcctcctcagcattgcaattcctctcccatctgggcaccagtcagctaccctggtgggaatctgggtagcc

SEQ ID NO: 1195 - DNA, 158 bp, Artificial Sequence
  Description of Artificial Sequence: Synthetic oligonucleotide
gtgctgggcggggggcggcgggccctcccgcagaacaccatgcgctcttcggaagtttatgaactgatcttaccctgtgacctggttaacgtcagttcataaacttctgaggagcgccttgacagcagccatgggagggccgccccctacctcagtga

SEQ ID NO: 1196 - DNA, 158 bp, Artificial Sequence
  Description of Artificial Sequence: Synthetic oligonucleotide
gtgctgggcggggggcggcgggccctcccgcagaacaccatgcgctcttcggaagtttatgaactgatcttagcctgtgacctggttaacgtcagttcataaacttctgaggagcgccttgacagcagccatgggagggccgccccctacctcagtga

SEQ ID NO: 1197 - DNA, 158 bp, Artificial Sequence
  Description of Artificial Sequence: Synthetic oligonucleotide
gtgctgggcggggggcggcgggccctcccgcagaacaccatgcgctcttcggaagtttatgaactgatcttaccctgtgatttggttaacgtcagttcataaacttctgaggagcgccttgacagcagccatgggagggccgccccctacctcagtga

SEQ ID NO: 1198 - DNA, 158 bp, Artificial Sequence
  Description of Artificial Sequence: Synthetic oligonucleotide
gtgctgggcggggggcggcgggccctcccgcagaacaccatgcgctcttcggaagtttatgaagtgatcttaacctgtgacctggttaacgtcagttcataaacttctgtggagcgccttgacagcagccatgggagggccgccccctacctcagtga

SEQ ID NO: 1199 - DNA, 158 bp, Artificial Sequence
  Description of Artificial Sequence: Synthetic oligonucleotide
gtgctgggcggggggcggcgggccctcccgcagaacaccatgcgctcttcggaagtttatgaactgatcttaacctgtgacctggttaacgtcagttcataaacttctgtggagcgccttgacagcagccatgggagggccgccccctacctcagtga

SEQ ID NO: 1200 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagagtttatgaactgatcttacccgtctgcacctgtcactagttaacgtcagttcataaactttggccgtgtagtgctacccagcgctggctgcctcctcagcattgcaattcctctcccatctgggcaccagtcagctaccctggtgggaatctgggtagcc

SEQ ID NO: 1201 - DNA, 158 bp, Artificial Sequence
  Description of Artificial Sequence: Synthetic oligonucleotide
gtgctgggcggggggcggcgggccctcccgcagaacaccatgcgctcttcggaagtttatgaactgatcttgccctgtgacctggttaacgtcagttcataaacttctgaggagcgccttgacagcagccatgggagggccgccccctacctcagtga

SEQ ID NO: 1202 - DNA, 158 bp, Artificial Sequence
  Description of Artificial Sequence: Synthetic oligonucleotide
gtgctgggcggggggcggcgggccctcccgcagaacaccatgcgctcttcggaagtttatgaactgatcttggcctgtgacctggttaacgtcagttcataaacttctgaggagcgccttgacagcagccatgggagggccgccccctacctcagtga

SEQ ID NO: 1203 - DNA, 158 bp, Artificial Sequence
  Description of Artificial Sequence: Synthetic oligonucleotide
gtgctgggcggggggcggcgggccctcccgcagaacaccatgcgctcttcggaagtttatgaactgatcttgccctgtgatttggttaacgtcagttcataaacttctgaggagcgccttgacagcagccatgggagggccgccccctacctcagtga

SEQ ID NO: 1204 - DNA, 158 bp, Artificial Sequence
  Description of Artificial Sequence: Synthetic oligonucleotide
gtgctgggcggggggcggcgggccctcccgcagaacaccatgcgctcttcggaagtttatgaactgatcttgacctgtgacctggttaacgtcagttcataaacttctgtggagcgccttgacagcagccatgggagggccgccccctacctcagtga

SEQ ID NO: 1205 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagagtttatgaactgatcttgcccgtctgcacctgtcactagttaacgtcagttcataaactttggccgtgtagtgctacccagcgctggctgcctcctcagcattgcaattcctctcccatctgggcaccagtcagctaccctggtgggaatctgggtagcc

SEQ ID NO: 1206 - DNA, 158 bp, Artificial Sequence
  Description of Artificial Sequence: Synthetic oligonucleotide
gtgctgggcggggggcggcgggccctcccgcagaacaccatgcgctcttcggaaccacaatgttgtgactggccctgtgacctggtccggtcacaacattgtggttctgaggagcgccttgacagcagccatgggagggccgccccctacctcagtga

SEQ ID NO: 1207 - DNA, 158 bp, Artificial Sequence
  Description of Artificial Sequence: Synthetic oligonucleotide
gtgctgggcggggggcggcgggccctcccgcagaacaccatgcgctcttcggaaccacaatgttgtgactgggcctgtgacctggtccggtcacaacattgtggttctgaggagcgccttgacagcagccatgggagggccgccccctacctcagtga

SEQ ID NO: 1208 - DNA, 158 bp, Artificial Sequence
  Description of Artificial Sequence: Synthetic oligonucleotide
gtgctgggcggggggcggcgggccctcccgcagaacaccatgcgctcttcggaaccacaatgttgtgactggacctgtgatttggtccggtcacaacattgtggttctgaggagcgccttgacagcagccatgggagggccgccccctacctcagtga

SEQ ID NO: 1209 - DNA, 158 bp, Artificial Sequence
  Description of Artificial Sequence: Synthetic oligonucleotide
gtgctgggcggggggcggcgggccctcccgcagaacaccatgcgctcttcggaaccacaatgtagtgactggacctgtgacctggtccggtcacaacattgtggttctgtggagcgccttgacagcagccatgggagggccgccccctacctcagtga

SEQ ID NO: 1210 - DNA, 158 bp, Artificial Sequence
  Description of Artificial Sequence: Synthetic oligonucleotide
gtgctgggcggggggcggcgggccctcccgcagaacaccatgcgctcttcggaaccacaatgttgtgactggacctgtgacctggtccggtcacaacattgtggttctgtggagcgccttgacagcagccatgggagggccgccccctacctcagtga

SEQ ID NO: 1211 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagaccacaatgttgtgactggaccgtctgcacctgtcactagtccggtcacaacattgtggtttggccgtgtagtgctacccagcgctggctgcctcctcagcattgcaattcctctcccatctgggcaccagtcagctaccctggtgggaatctgggtagcc

SEQ ID NO: 1212 - DNA, 158 bp, Artificial Sequence
  Description of Artificial Sequence: Synthetic oligonucleotide
gtgctgggcggggggcggcgggccctcccgcagaacaccatgcgctcttcggaagtgttagacggtactgatccctgtgacctggtgtcggtaccgtctaacacttctgaggagcgccttgacagcagccatgggagggccgccccctacctcagtga

SEQ ID NO: 1213 - DNA, 158 bp, Artificial Sequence
  Description of Artificial Sequence: Synthetic oligonucleotide
gtgctgggcggggggcggcgggccctcccgcagaacaccatgcgctcttcggaagtgttagacggtactgatgcctgtgacctggtgtcggtaccgtctaacacttctgaggagcgccttgacagcagccatgggagggccgccccctacctcagtga

SEQ ID NO: 1214 - DNA, 158 bp, Artificial Sequence
  Description of Artificial Sequence: Synthetic oligonucleotide
gtgctgggcggggggcggcgggccctcccgcagaacaccatgcgctcttcggaagtgttagacggtactgatccctgtgatttggtgtcggtaccgtctaacacttctgaggagcgccttgacagcagccatgggagggccgccccctacctcagtga

SEQ ID NO: 1215 - DNA, 158 bp, Artificial Sequence
  Description of Artificial Sequence: Synthetic oligonucleotide
gtgctgggcggggggcggcgggccctcccgcagaacaccatgcgctcttcggaagtgttagaccgtactgatacctgtgacctggtgtcggtaccgtctaacacttctgtggagcgccttgacagcagccatgggagggccgccccctacctcagtga

SEQ ID NO: 1216 - DNA, 158 bp, Artificial Sequence
  Description of Artificial Sequence: Synthetic oligonucleotide
gtgctgggcggggggcggcgggccctcccgcagaacaccatgcgctcttcggaagtgttagacggtactgatacctgtgacctggtgtcggtaccgtctaacacttctgtggagcgccttgacagcagccatgggagggccgccccctacctcagtga

SEQ ID NO: 1217 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagagtgttagacggtactgatcccgtctgcacctgtcactagtgtcggtaccgtctaacactttggccgtgtagtgctacccagcgctggctgcctcctcagcattgcaattcctctcccatctgggcaccagtcagctaccctggtgggaatctgggtagcc

SEQ ID NO: 1218 - DNA, 158 bp, Artificial Sequence
  Description of Artificial Sequence: Synthetic oligonucleotide
gtgctgggcggggggcggcgggccctcccgcagaacaccatgcgctcttcggaaccgacaaccagtatttggccctgtgacctggtccaaatactggttgtcggttctgaggagcgccttgacagcagccatgggagggccgccccctacctcagtga

SEQ ID NO: 1219 - DNA, 158 bp, Artificial Sequence
  Description of Artificial Sequence: Synthetic oligonucleotide
gtgctgggcggggggcggcgggccctcccgcagaacaccatgcgctcttcggaaccgacaaccagtatttgggcctgtgacctggtccaaatactggttgtcggttctgaggagcgccttgacagcagccatgggagggccgccccctacctcagtga

SEQ ID NO: 1220 - DNA, 158 bp, Artificial Sequence
  Description of Artificial Sequence: Synthetic oligonucleotide
gtgctgggcggggggcggcgggccctcccgcagaacaccatgcgctcttcggaaccgacaaccagtatttggacctgtgatttggtccaaatactggttgtcggttctgaggagcgccttgacagcagccatgggagggccgccccctacctcagtga

SEQ ID NO: 1221 - DNA, 158 bp, Artificial Sequence
  Description of Artificial Sequence: Synthetic oligonucleotide
gtgctgggcggggggcggcgggccctcccgcagaacaccatgcgctcttcggaaccgacaacctgtatttggacctgtgacctggtccaaatactggttgtcggttctgtggagcgccttgacagcagccatgggagggccgccccctacctcagtga

SEQ ID NO: 1222 - DNA, 158 bp, Artificial Sequence
  Description of Artificial Sequence: Synthetic oligonucleotide
gtgctgggcggggggcggcgggccctcccgcagaacaccatgcgctcttcggaaccgacaaccagtatttggacctgtgacctggtccaaatactggttgtcggttctgtggagcgccttgacagcagccatgggagggccgccccctacctcagtga

SEQ ID NO: 1223 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagaccgacaaccagtatttggaccgtctgcacctgtcactagtccaaatactggttgtcggtttggccgtgtagtgctacccagcgctggctgcctcctcagcattgcaattcctctcccatctgggcaccagtcagctaccctggtgggaatctgggtagcc

SEQ ID NO: 1224 - DNA, 158 bp, Artificial Sequence
  Description of Artificial Sequence: Synthetic oligonucleotide
gtgctgggcggggggcggcgggccctcccgcagaacaccatgcgctcttcggaagtcacaaagaaccgtgtaccctgtgacctggttgcacggttctttgtgacttctgaggagcgccttgacagcagccatgggagggccgccccctacctcagtga

SEQ ID NO: 1225 - DNA, 158 bp, Artificial Sequence
  Description of Artificial Sequence: Synthetic oligonucleotide
gtgctgggcggggggcggcgggccctcccgcagaacaccatgcgctcttcggaagtcacaaagaaccgtgtagcctgtgacctggttgcacggttctttgtgacttctgaggagcgccttgacagcagccatgggagggccgccccctacctcagtga

SEQ ID NO: 1226 - DNA, 158 bp, Artificial Sequence
  Description of Artificial Sequence: Synthetic oligonucleotide
gtgctgggcggggggcggcgggccctcccgcagaacaccatgcgctcttcggaagtcacaaagaaccgtgtaacctgtgatttggttgcacggttctttgtgacttctgaggagcgccttgacagcagccatgggagggccgccccctacctcagtga

SEQ ID NO: 1227 - DNA, 158 bp, Artificial Sequence
  Description of Artificial Sequence: Synthetic oligonucleotide
gtgctgggcggggggcggcgggccctcccgcagaacaccatgcgctcttcggaagtcacaaagtaccgtgtaacctgtgacctggttgcacggttctttgtgacttctgtggagcgccttgacagcagccatgggagggccgccccctacctcagtga

SEQ ID NO: 1228 - DNA, 158 bp, Artificial Sequence
  Description of Artificial Sequence: Synthetic oligonucleotide
gtgctgggcggggggcggcgggccctcccgcagaacaccatgcgctcttcggaagtcacaaagaaccgtgtaacctgtgacctggttgcacggttctttgtgacttctgtggagcgccttgacagcagccatgggagggccgccccctacctcagtga

SEQ ID NO: 1229 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagagtcacaaagaaccgtgtaaccgtctgcacctgtcactagttgcacggttctttgtgactttggccgtgtagtgctacccagcgctggctgcctcctcagcattgcaattcctctcccatctgggcaccagtcagctaccctggtgggaatctgggtagcc

SEQ ID NO: 1230 - DNA, 158 bp, Artificial Sequence
  Description of Artificial Sequence: Synthetic oligonucleotide
gtgctgggcggggggcggcgggccctcccgcagaacaccatgcgctcttcggaatgaacctcttgttataaaccctgtgacctggttttataacaagaggttcattctgaggagcgccttgacagcagccatgggagggccgccccctacctcagtga

SEQ ID NO: 1231 - DNA, 158 bp, Artificial Sequence
  Description of Artificial Sequence: Synthetic oligonucleotide
gtgctgggcggggggcggcgggccctcccgcagaacaccatgcgctcttcggaatgaacctcttgttataaagcctgtgacctggttttataacaagaggttcattctgaggagcgccttgacagcagccatgggagggccgccccctacctcagtga

SEQ ID NO: 1232 - DNA, 158 bp, Artificial Sequence
  Description of Artificial Sequence: Synthetic oligonucleotide
gtgctgggcggggggcggcgggccctcccgcagaacaccatgcgctcttcggaatgaacctcttgttataaaacctgtgatttggttttataacaagaggttcattctgaggagcgccttgacagcagccatgggagggccgccccctacctcagtga

SEQ ID NO: 1233 - DNA, 158 bp, Artificial Sequence
  Description of Artificial Sequence: Synthetic oligonucleotide
gtgctgggcggggggcggcgggccctcccgcagaacaccatgcgctcttcggaatgaacctctagttataaaacctgtgacctggttttataacaagaggttcattctgtggagcgccttgacagcagccatgggagggccgccccctacctcagtga

SEQ ID NO: 1234 - DNA, 158 bp, Artificial Sequence
  Description of Artificial Sequence: Synthetic oligonucleotide
gtgctgggcggggggcggcgggccctcccgcagaacaccatgcgctcttcggaatgaacctcttgttataaaacctgtgacctggttttataacaagaggttcattctgtggagcgccttgacagcagccatgggagggccgccccctacctcagtga

SEQ ID NO: 1235 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagatgaacctcttgttataaaaccgtctgcacctgtcactagttttataacaagaggttcatttggccgtgtagtgctacccagcgctggctgcctcctcagcattgcaattcctctcccatctgggcaccagtcagctaccctggtgggaatctgggtagcc

SEQ ID NO: 1236 - DNA, 158 bp, Artificial Sequence
  Description of Artificial Sequence: Synthetic oligonucleotide
gtgctgggcggggggcggcgggccctcccgcagaacaccatgcgctcttcggaagatcattggaattcctaatcctgtgacctggtttaggaattccaatgatcttctgaggagcgccttgacagcagccatgggagggccgccccctacctcagtga

SEQ ID NO: 1237 - DNA, 158 bp, Artificial Sequence
  Description of Artificial Sequence: Synthetic oligonucleotide
gtgctgggcggggggcggcgggccctcccgcagaacaccatgcgctcttcggaagatcattggaattcctaagcctgtgacctggtttaggaattccaatgatcttctgaggagcgccttgacagcagccatgggagggccgccccctacctcagtga

SEQ ID NO: 1238 - DNA, 158 bp, Artificial Sequence
  Description of Artificial Sequence: Synthetic oligonucleotide
gtgctgggcggggggcggcgggccctcccgcagaacaccatgcgctcttcggaagatcattggaattcctaaacctgtgatttggtttaggaattccaatgatcttctgaggagcgccttgacagcagccatgggagggccgccccctacctcagtga

SEQ ID NO: 1239 - DNA, 158 bp, Artificial Sequence
  Description of Artificial Sequence: Synthetic oligonucleotide
gtgctgggcggggggcggcgggccctcccgcagaacaccatgcgctcttcggaagatcattggtattcctaaacctgtgacctggtttaggaattccaatgatcttctgtggagcgccttgacagcagccatgggagggccgccccctacctcagtga

SEQ ID NO: 1240 - DNA, 158 bp, Artificial Sequence
  Description of Artificial Sequence: Synthetic oligonucleotide
gtgctgggcggggggcggcgggccctcccgcagaacaccatgcgctcttcggaagatcattggaattcctaaacctgtgacctggtttaggaattccaatgatcttctgtggagcgccttgacagcagccatgggagggccgccccctacctcagtga

SEQ ID NO: 1241 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagagatcattggaattcctaaaccgtctgcacctgtcactagtttaggaattccaatgatctttggccgtgtagtgctacccagcgctggctgcctcctcagcattgcaattcctctcccatctgggcaccagtcagctaccctggtgggaatctgggtagcc

SEQ ID NO: 1242 - DNA, 158 bp, Artificial Sequence
  Description of Artificial Sequence: Synthetic oligonucleotide
gtgctgggcggggggcggcgggccctcccgcagaacaccatgcgctcttcggaacattggaattcctaaaattcctgtgacctggtattttaggaattccaatgttctgaggagcgccttgacagcagccatgggagggccgccccctacctcagtga

SEQ ID NO: 1243 - DNA, 158 bp, Artificial Sequence
  Description of Artificial Sequence: Synthetic oligonucleotide
gtgctgggcggggggcggcgggccctcccgcagaacaccatgcgctcttcggaacattggaattcctaaaatgcctgtgacctggtattttaggaattccaatgttctgaggagcgccttgacagcagccatgggagggccgccccctacctcagtga

SEQ ID NO: 1244 - DNA, 158 bp, Artificial Sequence
  Description of Artificial Sequence: Synthetic oligonucleotide
gtgctgggcggggggcggcgggccctcccgcagaacaccatgcgctcttcggaacattggaattcctaaaatacctgtgatttggtattttaggaattccaatgttctgaggagcgccttgacagcagccatgggagggccgccccctacctcagtga

SEQ ID NO: 1245 - DNA, 158 bp, Artificial Sequence
  Description of Artificial Sequence: Synthetic oligonucleotide
gtgctgggcggggggcggcgggccctcccgcagaacaccatgcgctcttcggaacattggaatacctaaaatacctgtgacctggtattttaggaattccaatgttctgtggagcgccttgacagcagccatgggagggccgccccctacctcagtga

SEQ ID NO: 1246 - DNA, 158 bp, Artificial Sequence
  Description of Artificial Sequence: Synthetic oligonucleotide
gtgctgggcggggggcggcgggccctcccgcagaacaccatgcgctcttcggaacattggaattcctaaaatacctgtgacctggtattttaggaattccaatgttctgtggagcgccttgacagcagccatgggagggccgccccctacctcagtga

SEQ ID NO: 1247 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagacattggaattcctaaaataccgtctgcacctgtcactagtattttaggaattccaatgtttggccgtgtagtgctacccagcgctggctgcctcctcagcattgcaattcctctcccatctgggcaccagtcagctaccctggtgggaatctgggtagcc

SEQ ID NO: 1248 - DNA, 158 bp, Artificial Sequence
  Description of Artificial Sequence: Synthetic oligonucleotide
gtgctgggcggggggcggcgggccctcccgcagaacaccatgcgctcttcggaagcaattcagtctcgttgtccctgtgacctggtacaacgagactgaattgcttctgaggagcgccttgacagcagccatgggagggccgccccctacctcagtga

SEQ ID NO: 1249 - DNA, 158 bp, Artificial Sequence
  Description of Artificial Sequence: Synthetic oligonucleotide
gtgctgggcggggggcggcgggccctcccgcagaacaccatgcgctcttcggaagcaattcagtctcgttgtgcctgtgacctggtacaacgagactgaattgcttctgaggagcgccttgacagcagccatgggagggccgccccctacctcagtga

SEQ ID NO: 1250 - DNA, 158 bp, Artificial Sequence
  Description of Artificial Sequence: Synthetic oligonucleotide
gtgctgggcggggggcggcgggccctcccgcagaacaccatgcgctcttcggaagcaattcagtctcgttgtacctgtgatttggtacaacgagactgaattgcttctgaggagcgccttgacagcagccatgggagggccgccccctacctcagtga

SEQ ID NO: 1251 - DNA, 158 bp, Artificial Sequence
  Description of Artificial Sequence: Synthetic oligonucleotide
gtgctgggcggggggcggcgggccctcccgcagaacaccatgcgctcttcggaagcaattcagactcgttgtacctgtgacctggtacaacgagactgaattgcttctgtggagcgccttgacagcagccatgggagggccgccccctacctcagtga

SEQ ID NO: 1252 - DNA, 158 bp, Artificial Sequence
  Description of Artificial Sequence: Synthetic oligonucleotide
gtgctgggcggggggcggcgggccctcccgcagaacaccatgcgctcttcggaagcaattcagtctcgttgtacctgtgacctggtacaacgagactgaattgcttctgtggagcgccttgacagcagccatgggagggccgccccctacctcagtga

SEQ ID NO: 1253 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagagcaattcagtctcgttgtaccgtctgcacctgtcactagtacaacgagactgaattgctttggccgtgtagtgctacccagcgctggctgcctcctcagcattgcaattcctctcccatctgggcaccagtcagctaccctggtgggaatctgggtagcc

SEQ ID NO: 1254 - DNA, 158 bp, Artificial Sequence
  Description of Artificial Sequence: Synthetic oligonucleotide
gtgctgggcggggggcggcgggccctcccgcagaacaccatgcgctcttcggaacctgctagctccatgcttccctgtgacctggtaagcatggagctagcaggttctgaggagcgccttgacagcagccatgggagggccgccccctacctcagtga

SEQ ID NO: 1255 - DNA, 158 bp, Artificial Sequence
  Description of Artificial Sequence: Synthetic oligonucleotide
gtgctgggcggggggcggcgggccctcccgcagaacaccatgcgctcttcggaacctgctagctccatgcttgcctgtgacctggtaagcatggagctagcaggttctgaggagcgccttgacagcagccatgggagggccgccccctacctcagtga

SEQ ID NO: 1256 - DNA, 158 bp, Artificial Sequence
  Description of Artificial Sequence: Synthetic oligonucleotide
gtgctgggcggggggcggcgggccctcccgcagaacaccatgcgctcttcggaacctgctagctccatgcttccctgtgatttggtaagcatggagctagcaggttctgaggagcgccttgacagcagccatgggagggccgccccctacctcagtga

SEQ ID NO: 1257 - DNA, 158 bp, Artificial Sequence
  Description of Artificial Sequence: Synthetic oligonucleotide
gtgctgggcggggggcggcgggccctcccgcagaacaccatgcgctcttcggaacctgctagcaccatgcttacctgtgacctggtaagcatggagctagcaggttctgtggagcgccttgacagcagccatgggagggccgccccctacctcagtga

SEQ ID NO: 1258 - DNA, 158 bp, Artificial Sequence
  Description of Artificial Sequence: Synthetic oligonucleotide
gtgctgggcggggggcggcgggccctcccgcagaacaccatgcgctcttcggaacctgctagctccatgcttacctgtgacctggtaagcatggagctagcaggttctgtggagcgccttgacagcagccatgggagggccgccccctacctcagtga

SEQ ID NO: 1259 - DNA, 260 bp, Artificial Sequence
  Description of Artificial Sequence: Synthetic oligonucleotide
gaagcaaagaaggggcagagggagcccgtgagctgagtgggccagggactgggagaaggagtgaggaggcagggccggcatgcctctgctgctggccagacctgctagctccatgcttcccgtctgcacctgtcactagtaagcatggagctagcaggtttggccgtgtagtgctacccagcgctggctgcctcctcagcattgcaattcctctcccatctgggcaccagtcagctaccctggtgggaatctgggtagcc

SEQ ID NO: 1260 - DNA, 158 bp, Artificial Sequence
  Description of Artificial Sequence: Synthetic oligonucleotide
gtgctgggcggggggcggcgggccctcccgcagaacaccatgcgctcttcggaacctgctagctccatgcttgctgtgacccaagtaagcatggagctagcaggttctgaggagcgccttgacagcagccatgggagggccgccccctacctcagtga

SEQ ID NO: 1261 - DNA, 158 bp, Artificial Sequence
  Description of Artificial Sequence: Synthetic oligonucleotide
gtgctgggcggggggcggcgggccctcccgcagaacaccatgcgctccacggaacctgctagctccatgcttgctgtgacccaagtaagcatggagctagcaggttctgaggagcgccttgacagcagccatgggagggccgccccctacctcagtga

SEQ ID NO: 1262 - DNA, 163 bp, Artificial Sequence
  Description of Artificial Sequence: Synthetic oligonucleotide
gtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtga

SEQ ID NO: 1263 - DNA, 122 bp, Artificial Sequence
  Description of Artificial Sequence: Synthetic oligonucleotide
gggccctcccgcagaacaccatgcgctccacggaacctgctagctccatgcttgctgtgacccaagtaagcatggagctagcaggttctgaggagcgccttgacagcagccatgggagggcc

SEQ ID NO: 1264 - DNA, 117 bp, Artificial Sequence
  Description of Artificial Sequence: Synthetic oligonucleotide
ctcccgcagaacaccatgcgctccacggaacctgctagctccatgcttgctgtgacccaagtaagcatggagctagcaggttctgaggagcgccttgacagcagccatgggagggcc

SEQ ID NO: 1265 - DNA, 160 bp, Artificial Sequence
  Description of Artificial Sequence: Synthetic oligonucleotide
gtgctgggcggggggcggcgggccctcccgcagaacaccatgcgctccacggaagcctgctagctccatgcttgctgtgacccaagtaagcatggagctagcaggcttctgaggagcgccttgacagcagccatgggagggccgccccctacctcagtga

SEQ ID NO: 1266 - DNA, 158 bp, Artificial Sequence
  Description of Artificial Sequence: Synthetic oligonucleotide
gtgctgggcggggggcggcgggccctcccgcagaacaccatgcgctccacggaacctgctagctccatgcttgatgtgacccaattaagcatggagctagcaggttctgaggagcgccttgacagcagccatgggagggccgccccctacctcagtga

SEQ ID NO: 1267 - DNA, 158 bp, Artificial Sequence
  Description of Artificial Sequence: Synthetic oligonucleotide
gtgctgggcggggggcggcgggccctcccgcagaacaccatgcgctcctcggaacctgctagctccatgcttgctgtgacccaagtaagcatggagctagcaggttctgcggagcgccttgacagcagccatgggagggccgccccctacctcagtga

SEQ ID NO: 1268 - DNA, 158 bp, Artificial Sequence; identical to SEQ ID NO: 1242
  Description of Artificial Sequence: Synthetic oligonucleotide

SEQ ID NO: 1269 - DNA, 158 bp, Artificial Sequence; identical to SEQ ID NO: 1236
  Description of Artificial Sequence: Synthetic oligonucleotide

SEQ ID NO: 1270 - DNA, 158 bp, Artificial Sequence; identical to SEQ ID NO: 1243
  Description of Artificial Sequence: Synthetic oligonucleotide

SEQ ID NO: 1271 - DNA, 158 bp, Artificial Sequence; identical to SEQ ID NO: 1237
  Description of Artificial Sequence: Synthetic oligonucleotide

SEQ ID NO: 1272 - DNA, 158 bp, Artificial Sequence; identical to SEQ ID NO: 1244
  Description of Artificial Sequence: Synthetic oligonucleotide

SEQ ID NO: 1273 - DNA, 158 bp, Artificial Sequence; identical to SEQ ID NO: 1238
  Description of Artificial Sequence: Synthetic oligonucleotide

SEQ ID NO: 1274 - DNA, 158 bp, Artificial Sequence; identical to SEQ ID NO: 1245
  Description of Artificial Sequence: Synthetic oligonucleotide

SEQ ID NO: 1275 - DNA, 158 bp, Artificial Sequence; identical to SEQ ID NO: 1239
  Description of Artificial Sequence: Synthetic oligonucleotide

SEQ ID NO: 1276 - DNA, 158 bp, Artificial Sequence; identical to SEQ ID NO: 1246
  Description of Artificial Sequence: Synthetic oligonucleotide

SEQ ID NO: 1277 - DNA, 158 bp, Artificial Sequence; identical to SEQ ID NO: 1240
  Description of Artificial Sequence: Synthetic oligonucleotide

SEQ ID NO: 1278 - DNA, 260 bp, Artificial Sequence; identical to SEQ ID NO: 1247
  Description of Artificial Sequence: Synthetic oligonucleotide

SEQ ID NO: 1279 - DNA, 260 bp, Artificial Sequence; identical to SEQ ID NO: 1241
  Description of Artificial Sequence: Synthetic oligonucleotide

SEQ ID NO: 1280 - DNA, 21 bp, Artificial Sequence
  Description of Artificial Sequence: Synthetic oligonucleotide
gtttatgaactgatcttaccc

SEQ ID NO: 1281 - DNA, 21 bp, Artificial Sequence
  Description of Artificial Sequence: Synthetic oligonucleotide
gtgttagacggtactgatccc

SEQ ID NO: 1282 - DNA, 21 bp, Artificial Sequence
  Description of Artificial Sequence: Synthetic oligonucleotide
cctgctagctccatgcttccc

SEQ ID NO: 1283 - DNA, 21 bp, Artificial Sequence
  Description of Artificial Sequence: Synthetic oligonucleotide
gtttatgaactgatcttagcc

SEQ ID NO: 1284 - DNA, 21 bp, Artificial Sequence
  Description of Artificial Sequence: Synthetic oligonucleotide
gtgttagacggtactgatgcc

SEQ ID NO: 1285 - DNA, 21 bp, Artificial Sequence
  Description of Artificial Sequence: Synthetic oligonucleotide
cctgctagctccatgcttgcc

SEQ ID NO: 1286 - DNA, 21 bp, Artificial Sequence
  Description of Artificial Sequence: Synthetic oligonucleotide
gtttatgaagtgatcttaacc

SEQ ID NO: 1287 - DNA, 21 bp, Artificial Sequence
  Description of Artificial Sequence: Synthetic oligonucleotide
gtgttagaccgtactgatacc

SEQ ID NO: 1288 - DNA, 21 bp, Artificial Sequence
  Description of Artificial Sequence: Synthetic oligonucleotide
cctgctagcaccatgcttacc

SEQ ID NO: 1289 - DNA, 21 bp, Artificial Sequence
  Description of Artificial Sequence: Synthetic oligonucleotide
gtttatgaactgatcttaacc

SEQ ID NO: 1290 - DNA, 21 bp, Artificial Sequence
  Description of Artificial Sequence: Synthetic oligonucleotide
gtgttagacggtactgatacc

SEQ ID NO: 1291 - DNA, 21 bp, Artificial Sequence
  Description of Artificial Sequence: Synthetic oligonucleotide
cctgctagctccatgcttacc

SEQ ID NO: 1292 - DNA, 21 bp, Artificial Sequence
  Description of Artificial Sequence: Synthetic oligonucleotide
gtttatgaactgatcttgccc

SEQ ID NO: 1293 - DNA, 21 bp, Artificial Sequence
  Description of Artificial Sequence: Synthetic oligonucleotide
gtttatgaactgatcttggcc

SEQ ID NO: 1294 - DNA, 21 bp, Artificial Sequence
  Description of Artificial Sequence: Synthetic oligonucleotide
gtttatgaactgatcttgacc

SEQ ID NO: 1295 - DNA, 21 bp, Artificial Sequence
  Description of Artificial Sequence: Synthetic oligonucleotide
gcaattcagtctcgttgtccc

SEQ ID NO: 1296 - DNA, 21 bp, Artificial Sequence
  Description of Artificial Sequence: Synthetic oligonucleotide
tccaggtttatgaactgaccc

SEQ ID NO: 1297 - DNA, 21 bp, Artificial Sequence
  Description of Artificial Sequence: Synthetic oligonucleotide
ggtttatgaactgacgttccc

SEQ ID NO: 1298 - DNA, 21 bp, Artificial Sequence
  Description of Artificial Sequence: Synthetic oligonucleotide
ccacaatgttgtgactggccc

SEQ ID NO: 1299 - DNA, 21 bp, Artificial Sequence
  Description of Artificial Sequence: Synthetic oligonucleotide
gtcacaaagaaccgtgtaccc

SEQ ID NO: 1300 - DNA, 21 bp, Artificial Sequence
  Description of Artificial Sequence: Synthetic oligonucleotide
tgaacctcttgttataaaccc

SEQ ID NO: 1301 - DNA, 21 bp, Artificial Sequence
  Description of Artificial Sequence: Synthetic oligonucleotide
ccgacaaccagtatttggccc

SEQ ID NO: 1302 - DNA, 21 bp, Artificial Sequence
  Description of Artificial Sequence: Synthetic oligonucleotide
gcaattcagtctcgttgtgcc

SEQ ID NO: 1303 - DNA, 21 bp, Artificial Sequence
  Description of Artificial Sequence: Synthetic oligonucleotide
tccaggtttatgaactgagcc

SEQ ID NO: 1304 - DNA, 21 bp, Artificial Sequence
  Description of Artificial Sequence: Synthetic oligonucleotide
ggtttatgaactgacgttgcc

SEQ ID NO: 1305 - DNA, 21 bp, Artificial Sequence
  Description of Artificial Sequence: Synthetic oligonucleotide
ccacaatgttgtgactgggcc

SEQ ID NO: 1306 - DNA, 21 bp, Artificial Sequence
  Description of Artificial Sequence: Synthetic oligonucleotide
gtcacaaagaaccgtgtagcc

SEQ ID NO: 1307 - DNA, 21 bp, Artificial Sequence
  Description of Artificial Sequence: Synthetic oligonucleotide
tgaacctcttgttataaagcc

SEQ ID NO: 1308 - DNA, 21 bp, Artificial Sequence
  Description of Artificial Sequence: Synthetic oligonucleotide
ccgacaaccagtatttgggcc

SEQ ID NO: 1309 - DNA, 21 bp, Artificial Sequence
  Description of Artificial Sequence: Synthetic oligonucleotide
gcaattcagtctcgttgtacc

SEQ ID NO: 1310 - DNA, 21 bp, Artificial Sequence
  Description of Artificial Sequence: Synthetic oligonucleotide
tccaggtttatgaactgaacc

SEQ ID NO: 1311 - DNA, 21 bp, Artificial Sequence
  Description of Artificial Sequence: Synthetic oligonucleotide
ggtttatgaactgacgttacc

SEQ ID NO: 1312 - DNA, 21 bp, Artificial Sequence
  Description of Artificial Sequence: Synthetic oligonucleotide
ccacaatgttgtgactggacc

SEQ ID NO: 1313 - DNA, 21 bp, Artificial Sequence
  Description of Artificial Sequence: Synthetic oligonucleotide
gtcacaaagaaccgtgtaacc

SEQ ID NO: 1314 - DNA, 21 bp, Artificial Sequence
  Description of Artificial Sequence: Synthetic oligonucleotide
tgaacctcttgttataaaacc

SEQ ID NO: 1315 - DNA, 21 bp, Artificial Sequence
  Description of Artificial Sequence: Synthetic oligonucleotide
ccgacaaccagtatttggacc

SEQ ID NO: 1316 - DNA, 21 bp, Artificial Sequence
  Description of Artificial Sequence: Synthetic oligonucleotide
gcaattcagactcgttgtacc

SEQ ID NO: 1317 - DNA, 21 bp, Artificial Sequence
  Description of Artificial Sequence: Synthetic oligonucleotide
tccaggtttttgaactgaacc

SEQ ID NO: 1318 - DNA, 21 bp, Artificial Sequence
  Description of Artificial Sequence: Synthetic oligonucleotide
ggtttatgatctgacgttacc

SEQ ID NO: 1319 - DNA, 21 bp, Artificial Sequence
  Description of Artificial Sequence: Synthetic oligonucleotide
ccacaatgtagtgactggacc

SEQ ID NO: 1320 - DNA, 21 bp, Artificial Sequence
  Description of Artificial Sequence: Synthetic oligonucleotide
gtcacaaagtaccgtgtaacc

SEQ ID NO: 1321 - DNA, 21 bp, Artificial Sequence
  Description of Artificial Sequence: Synthetic oligonucleotide
tgaacctctagttataaaacc

SEQ ID NO: 1322 - DNA, 21 bp, Artificial Sequence
  Description of Artificial Sequence: Synthetic oligonucleotide
ccgacaacctgtatttggacc

SEQ ID NO: 1323 - DNA, 21 bp, Artificial Sequence
  Description of Artificial Sequence: Synthetic oligonucleotide
cattggaattcctaaaattcc

SEQ ID NO: 1324 - DNA, 21 bp, Artificial Sequence
  Description of Artificial Sequence: Synthetic oligonucleotide
gatcattggaattcctaatcc

SEQ ID NO: 1325 - DNA, 21 bp, Artificial Sequence
  Description of Artificial Sequence: Synthetic oligonucleotide
cattggaattcctaaaatgcc

SEQ ID NO: 1326 - DNA, 21 bp, Artificial Sequence
  Description of Artificial Sequence: Synthetic oligonucleotide
gatcattggaattcctaagcc

SEQ ID NO: 1327 - DNA, 21 bp, Artificial Sequence
  Description of Artificial Sequence: Synthetic oligonucleotide
cattggaattcctaaaatacc

SEQ ID NO: 1328 - DNA, 21 bp, Artificial Sequence
  Description of Artificial Sequence: Synthetic oligonucleotide
gatcattggaattcctaaacc

SEQ ID NO: 1329 - DNA, 21 bp, Artificial Sequence
  Description of Artificial Sequence: Synthetic oligonucleotide
cattggaatacctaaaatacc

SEQ ID NO: 1330 - DNA, 21 bp, Artificial Sequence
  Description of Artificial Sequence: Synthetic oligonucleotide
gatcattggtattcctaaacc

SEQ ID NO: 1331 - DNA, 21 bp, Artificial Sequence
  Description of Artificial Sequence: Synthetic oligonucleotide
cctgctagctccatgcttgct

SEQ ID NO: 1332 - DNA, 21 bp, Artificial Sequence
  Description of Artificial Sequence: Synthetic oligonucleotide
cctgctagctccatgcttgat

SEQ ID NO: 1333 - DNA, 21 bp, Artificial Sequence
  Description of Artificial Sequence: Synthetic oligonucleotide
ttaacgtcagttcataaactt

SEQ ID NO: 1334 - DNA, 21 bp, Artificial Sequence
  Description of Artificial Sequence: Synthetic oligonucleotide
tgtcggtaccgtctaacactt

SEQ ID NO: 1335 - DNA, 21 bp, Artificial Sequence
  Description of Artificial Sequence: Synthetic oligonucleotide
taagcatggagctagcaggtt

SEQ ID NO: 1336 - DNA, 21 bp, Artificial Sequence
  Description of Artificial Sequence: Synthetic oligonucleotide
tacaacgagactgaattgctt

SEQ ID NO: 1337 - DNA, 21 bp, Artificial Sequence
  Description of Artificial Sequence: Synthetic oligonucleotide
ttcagttcataaacctggatt

SEQ ID NO: 1338 - DNA, 21 bp, Artificial Sequence
  Description of Artificial Sequence: Synthetic oligonucleotide
taacgtcagttcataaacctt

SEQ ID NO: 1339 - DNA, 21 bp, Artificial Sequence
  Description of Artificial Sequence: Synthetic oligonucleotide
tccggtcacaacattgtggtt

SEQ ID NO: 1340 - DNA, 21 bp, Artificial Sequence
  Description of Artificial Sequence: Synthetic oligonucleotide
ttgcacggttctttgtgactt

SEQ ID NO: 1341 - DNA, 21 bp, Artificial Sequence
  Description of Artificial Sequence: Synthetic oligonucleotide
ttttataacaagaggttcatt

SEQ ID NO: 1342 - DNA, 21 bp, Homo sapiens
tccaaatactggttgtcggtt

SEQ ID NO: 1343 - DNA, 21 bp, Artificial Sequence
  Description of Artificial Sequence: Synthetic oligonucleotide
tattttaggaattccaatgtt

SEQ ID NO: 1344 - DNA, 21 bp, Artificial Sequence
  Description of Artificial Sequence: Synthetic oligonucleotide
tttaggaattccaatgatctt

SEQ ID NO: 1345 - DNA, 22 bp, Artificial Sequence
  Description of Artificial Sequence: Synthetic oligonucleotide
taagcatggagctagcaggctt

SEQ ID NO: 1346 - DNA, 158 bp, Artificial Sequence
  Description of Artificial Sequence: Synthetic oligonucleotide
gtgctgggcggggggcggcgggccctcccgcagaacaccatgcgctccacggaataagcatggagctagcagggtgtgacccaaccctgctagctccatgcttattctgaggagcgccttgacagcagccatgggagggccgccccctacctcagtga

SEQ ID NO: 1347 - DNA, 163 bp, Artificial Sequence
  Description of Artificial Sequence: Synthetic oligonucleotide
gtgctgggcggggggcggcgggccctcccgcagaacaccatgcgctcctcggaataagcatggagctagcaggttgtggccactgagaaacctgctagctccatgcttgttctgcggagcgccttgacagcagccatgggagggccgccccctacctcagtga

SEQ ID NO: 1348 - DNA, 21 bp, Artificial Sequence
  Description of Artificial Sequence: Synthetic oligonucleotide
cctgctagctccatgcttatt

SEQ ID NO: 1349 - DNA, 21 bp, Artificial Sequence
  Description of Artificial Sequence: Synthetic oligonucleotide
cctgctagctccatgcttgtt

SEQ ID NO: 1350 - DNA, 21 bp, Artificial Sequence
  Description of Artificial Sequence: Synthetic oligonucleotide
taagcatggagctagcagggt

SEQ ID NO: 1351 - DNA, 21 bp, Artificial Sequence
  Description of Artificial Sequence: Synthetic oligonucleotide
taagcatggagctagcaggtt

SEQ ID NO: 1352 - DNA, 2301 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaataattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1353 - DNA, 4608 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaataattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcaggttgttcattggtcgcctttagttttccaaaataagtgtcactttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagcccctgcctggctttgctgtttgcccaccgtcccgtgtcagtgaatcacgggcatcttcaggagctcagcctgggtcttcatttgtttccctcggccccttcctcagcctcaggacagtgctgcagcccccacacattcttccctacagataccatggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcggcagctggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccttgggcactggatattgggaagggacagtgtccacactggagtgggaagttcccagggacgagacctttacctcctcaccctgggtactgttctcctcatggagcatggacggcgctgcctgaactcagtggtggcctcattctggaagccaagtttatacagagtagcagtgacccagggatgtggggttcaccctcctcagccctctggccagtcctgatgggcctcagtcccaacatggctaagaggtgtgggcagcttcttggtcaccctcaggttggggaatcaccttctgtcttcattttccaggaacttggtgatgatatcgtgggtgagttcatttaccaggtgctgtagtttcccctcatcaggcaggaagaagatggcggtggcattgcccaggtatttcatcagcagcacccagctggacagcttcttacagtgctggatgttaaacatgcctaaacgcttcatcataggcaccttcacggtggtcacctggtccacgtggaagtcctcttcctcggtgtccttgacttcaaagggtctctcccatttgcctggagagaggggaaggtgggcatcaccaggggtgagtgaaggtttggaagagtgtagcagaataagaaaccatgagtcccctccctgagaagccctgagcccccttgacgacacacatccctcgaggctcagcttcatcatctgtaaaaggtgctgaaactgaccatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1354 - DNA, 2296 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaagcaattcagtctcgttgtacctgtgatttggtacaacgagactgaattgcttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaataattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1355 - DNA, 2301 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcctcggaataagcatggagctagcaggttgtggccactgagaaacctgctagctccatgcttgttctgcggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaataattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1356 - DNA, 4606 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcaggttgttcattggtcgcctttagttttccaaaataagtgtcactttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagcccctgcctggctttgctgtttgcccaccgtcccgtgtcagtgaatcacgggcatcttcaggagctcagcctgggtcttcatttgtttccctcggccccttcctcagcctcaggacagtgctgcagcccccacacattcttccctacagataccatggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcggcagctggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccttgggcactggatattgggaagggacagtgtccacactggagtgggaagttcccagggacgagacctttacctcctcaccctgggtactgttctcctcatggagcatggacggcgctgcctgaactcagtggtggcctcattctggaagccaagtttatacagagtagcagtgacccagggatgtggggttcaccctcctcagccctctggccagtcctgatgggcctcagtcccaacatggctaagaggtgtgggcagcttcttggtcaccctcaggttggggaatcaccttctgtcttcattttccaggaacttggtgatgatatcgtgggtgagttcatttaccaggtgctgtagtttcccctcatcaggcaggaagaagatggcggtggcattgcccaggtatttcatcagcagcacccagctggacagcttcttacagtgctggatgttaaacatgcctaaacgcttcatcataggcaccttcacggtggtcacctggtccacgtggaagtcctcttcctcggtgtccttgacttcaaagggtctctcccatttgcctggagagaggggaaggtgggcatcaccaggggtgagtgaaggtttggaagagtgtagcagaataagaaaccatgagtcccctccctgagaagccctgagcccccttgacgacacacatccctcgaggctcagcttcatcatctgtaaaaggtgctgaaactgaccacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1357 - DNA, 2299 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1358 - DNA, 2294 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaagcaattcagtctcgttgtacctgtgatttggtacaacgagactgaattgcttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1359 - DNA, 2299 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcctcggaataagcatggagctagcaggttgtggccactgagaaacctgctagctccatgcttgttctgcggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1360 - DNA, 4618 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcagttgttcattggtcgcctttagttttccaaaataagtgtcatctttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagtcccctgcctggctttgctgtttgaccacgtcccgtgtcagtgaatcacgggcatcttcaggagctcagcctgggtcttcatttgtttccctcggccccttcctcagcctcaggacagagctgcagcccccacacattcttccctacagataccatggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaataatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcgggcagcttggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccctgggcactggatattgggaagggacagtgtccacactggagtgggaagtccccagggacgagacctttacctcctcacccctgggtactgtcctcctcatggagcatggatggcgctgcctgaactcagtggtggcctcattctggaagccaagtttatacagagtagcagtgacccagggatgtggggttcaccctcctcagccctctggccagtcctgatgggcctcagtcccaacatggctaagaggtgtgggcagcttcttggtcaccctcaggttggggaatcaccttctgtcttcattttccaggaacttggtgatgatatcgtgggtgagttcattttccaggtgctgtagtttcccctcatcaggcaggaagaagatggcggtggcattgcccaggtatttcatcagcagcacccagctggacagcttcttacagtgctggatgttaaacatgcctaaacgcttcatcataggcaccttcacggtggtcacctggtccacgtggaagtcctcttcctcggtgtccttgacttcaaagggtctctcccatttgcctggagagaggggaaggtgggcatcaccaggggtgagtgaaggtttggaagagtgtagcagaataaagaaaccatgagtcccctccctgagaagccctgagcccccttgacgacacacatccctcgaggctcagcttcatcatctgtaaaaggtgctgaaactgaccatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1361 - DNA, 2307 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggagggacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaatgagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1362 - DNA, 2302 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggagggacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaagcaattcagtctcgttgtacctgtgatttggtacaacgagactgaattgcttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaatgagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1363 - DNA, 2307 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggagggacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcctcggaataagcatggagctagcaggttgtggccactgagaaacctgctagctccatgcttgttctgcggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaatgagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1364 - DNA, 1587 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1365 - DNA, 1582 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaagcaattcagtctcgttgtgcctgtgacctggtacaacgagactgaattgcttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcgactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1366 - DNA, 1584 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgaagcaaagaaggggcagagggagcccgtgagctgagtgggccagggactgggagaaggagtgaggaggcagggccggcatgcctctgctgctggccagacctgctagctccatgcttcccgtctgcacctgtcactagtaagcatggagctagcaggtttggccgtgtagtgctacccagcgctggctgcctcctcagcattgcaattcctctcccatctgggcaccagtcagctaccctggtgggaatctgggtagccctcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1367 - DNA, 1482 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaagcaattcagtctcgttgtgcctgtgacctggtacaacgagactgaattgcttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1368 - DNA, 4606 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtatatctagacgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctagtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggattcgaatcccggccgggaacggtgcattggaacgcggattccccgtgccaagagtgacgtaagtaccgcctatagagtctataggcccacaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattgggattcgaacatcgattgaattccccggggatccaccgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttactagatttaaataattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcaggttgttcattggtcgcctttagttttccaaaataagtgtcactttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagcccctgcctggctttgctgtttgcccaccgtcccgtgtcagtgaatcacgggcatcttcaggagctcagcctgggtcttcatttgtttccctcggccccttcctcagcctcaggacagtgctgcagcccccacacattcttccctacagataccatggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcggcagctggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccttgggcactggatattgggaagggacagtgtccacactggagtgggaagttcccagggacgagacctttacctcctcaccctgggtactgttctcctcatggagcatggatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1369 - DNA, 2308 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtatatctagacgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctagtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggattcgaatcccggccgggaacggtgcattggaacgcggattccccgtgccaagagtgacgtaagtaccgcctatagagtctataggcccacaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattgggattcgaacatcgattgaattccccggggatccaccgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttactagatttaaataattcgcccttgggcctaggcaattggatccgccggcagagaaaacatcccagggatttacagatcacatgcaggcagggaccagctcaacccttctatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1370 - DNA, 4608 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcagttgttcattggtcgcctttagttttccaaaataagtgtcatctttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagtcccctgcctggctttgctgtttgaccacgtcccgtgtcagtgaatcacgggcatcttcaggagctcagcctgggtcttcatttgtttccctcggccccttcctcagcctcaggacagagctgcagcccccacacattcttccctacagataccagggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatgggggagacaatgccaccctgagcagggtctggtgtgagcgggcagcttggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccctgggcactggatattgggaagggacagtgtccacactggagtgggaagtccccagggacgagacctttacctcctcacccctgggtactgttctcctcatggagcatggacgcgtatatctagacgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctagtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggattcgaatcccggccgggaacggtgcattggaacgcggattccccgtgccaagagtgacgtaagtaccgcctatagagtctataggcccacaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattgggattcgaacatcgattgaattccccggggatccaccgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1371 - DNA, 2306 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcccagggatttacagatcacatgcaggcagggaccagctcaacccttctacgcgtatatctagacgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctagtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggattcgaatcccggccgggaacggtgcattggaacgcggattccccgtgccaagagtgacgtaagtaccgcctatagagtctataggcccacaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattgggattcgaacatcgattgaattccccggggatccaccgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1372 - DNA, 4598 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtatatctagacgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctagtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggattcgaatcccggccgggaacggtgcattggaacgcggattccccgtgccaagagtgacgtaagtaccgcctatagagtctataggcccacaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcaggttgttcattggtcgcctttagttttccaaaataagtgtcactttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagcccctgcctggctttgctgtttgcccaccgtcccgtgtcagtgaatcacgggcatcttcaggagctcagcctgggtcttcatttgtttccctcggccccttcctcagcctcaggacagtgctgcagcccccacacattcttccctacagataccatggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcggcagctggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccttgggcactggatattgggaagggacagtgtccacactggagtgggaagttcccagggacgagacctttacctcctcaccctgggtactgttctcctcatggagcatggaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattgggattcgaacatcgattgaattccccggggatccaccgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1373 - DNA, 2300 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtatatctagacgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctagtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggattcgaatcccggccgggaacggtgcattggaacgcggattccccgtgccaagagtgacgtaagtaccgcctatagagtctataggcccacaattcgcccttgggcctaggcaattggatccgccggcagagaaaacatcccagggatttacagatcacatgcaggcagggaccagctcaacccttctaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattgggattcgaacatcgattgaattccccggggatccaccgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1374 - DNA, 4615 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcagttgttcattggtcgcctttagttttccaaaataagtgtcatctttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagtcccctgcctggctttgctgtttgaccacgtcccgtgtcagtgaatcacgggcatcttcaggagctcagcctgggtcttcatttgtttccctcggccccttcctcagcctcaggacagagctgcagcccccacacattcttccctacagataccagggtgcaacaaggtcgtcagggtgatctcaccttggagagcttcaggggtgcctccacgcgtatatctagacgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctagtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggattcgaatcccggccgggaacggtgcattggaacgcggattccccgtgccaagagtgacgtaagtaccgcctatagagtctataggcccacaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattgggattcgaacatcgattgaattccccggggatccaccgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttactagatttaaattctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcgggcagcttggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccctgggcactggatattgggaagggacagtgtccacactggagtgggaagtccccagggacgagacctttacctcctcacccctgggtactgttctcctcatggagcatggatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1375 - DNA, 2314 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcgtcgacataacgcgtaattcgcccttgggcctaggcaattggatccgccggcagagaaaacatcacgcgtatatctagacgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctagtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggattcgaatcccggccgggaacggtgcattggaacgcggattccccgtgccaagagtgacgtaagtaccgcctatagagtctataggcccacaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattgggattcgaacatcgattgaattccccggggatccaccgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtcctgactagatttaaatccagggatttacagatcacatgcaggcagggaccagctcaactcttctatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1376 - DNA, 2198 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtatacatgcgtcgacataacgcgtatatctagacgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctagtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggattcgaatcccggccgggaacggtgcattggaacgcggattccccgtgccaagagtgacgtaagtaccgcctatagagtctataggcccacaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattgggattcgaacatcgattgaattccccggggatccaccgtgctgggcggggggcggcgggccctcccgcagaacaccatgcgctcttcggaagcaattcagtctcgttgtgcctgtgacctggtacaacgagactgaattgcttctgaggagcgccttgacagcagccatgggagggccgccccctacctcagtgactcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1377 - DNA, 2203 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtatacatgcgtcgacataacgcgtatatctagacgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctagtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggattcgaatcccggccgggaacggtgcattggaacgcggattccccgtgccaagagtgacgtaagtaccgcctatagagtctataggcccacaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattgggattcgaacatcgattgaattccccggggatccaccgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgagagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttactagatttaaatatgtcgtgcatcgatgctacgtagataagtagcatggcgggttaatcattaactacagaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1378 - DNA, 844 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgttgacgtacgaaattcgaacgctgacgtcatcaacccgctccaaggaatcgcgggcccagtgtcactaggcgggaacacccagcgcgcgtgcgccctggcaggaagatggctgtgagggacagggagtggcgccctgcaatatttgcatgtcgctatgtgttctgggaaatcaccataaacgtgaaatgtctttggatttgggaatcttataagttctgtatgagaccacaccggtgaagcaaagaaggggcagagggagcccgtgagctgagtgggccagggactgggagaaggagtgaggaggcagggccggcatgcctctgctgctggccagacctgctagctccatgcttcccgtctgcacctgtcactagtaagcatggagctagcaggtttggccgtgtagtgctacccagcgctggctgcctcctcagcattgcaattcctctcccatctgggcaccagtcagctaccctggtgggaatctgggtagccctcgagatagcggccgcccccgagatctttttatgtacatctagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1379 - DNA, 742 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgttgacgtacgaaattcgaacgctgacgtcatcaacccgctccaaggaatcgcgggcccagtgtcactaggcgggaacacccagcgcgcgtgcgccctggcaggaagatggctgtgagggacagggagtggcgccctgcaatatttgcatgtcgctatgtgttctgggaaatcaccataaacgtgaaatgtctttggatttgggaatcttataagttctgtatgagaccacaccggtgtgctgggcggggggcggcgggccctcccgcagaacaccatgcgctcttcggaagcaattcagtctcgttgtgcctgtgacctggtacaacgagactgaattgcttctgaggagcgccttgacagcagccatgggagggccgccccctacctcagtgactcgagatagcggccgcccccgagatctttttatgtacatctagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1380 - DNA, 141 bp, Artificial Sequence
  Description of Artificial Sequence: Synthetic oligonucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 1381 - DNA, 105 bp, Artificial Sequence
  Description of Artificial Sequence: Synthetic oligonucleotide
ctgcgcgctcgctcgctcactgaggccgcccgggcaaagcccgggcgtcgggcgacctttggtcgcccggcctcagtgagcgagcgagcgcgcagagagggagtg

SEQ ID NO: 1382 - DNA, 141 bp, Artificial Sequence
  Description of Artificial Sequence: Synthetic oligonucleotide
aggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 1383 - DNA, 130 bp, Artificial Sequence
  Description of Artificial Sequence: Synthetic oligonucleotide
aggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1384 - DNA, 10 bp, Artificial Sequence
  Description of Artificial Sequence: Synthetic oligonucleotide
gtcgacataa

SEQ ID NO: 1385 - DNA, 121 bp, Artificial Sequence
  Description of Artificial Sequence: Synthetic oligonucleotide
gtcgacataacgcgtaattcgcccttgggcctaggcaattggatccgccggcagagaaaacatcccagggatttacagatcacatgcaggcagggaccagctcaacccttctacgcgtata

SEQ ID NO: 1386 - DNA, 73 bp, Artificial Sequence
  Description of Artificial Sequence: Synthetic oligonucleotide
gtcgacataacgcgtaattcgcccttgggcctaggcaattggatccgccggcagagaaaacatcacgcgtata

SEQ ID NO: 1387 - DNA, 18 bp, Artificial Sequence
  Description of Artificial Sequence: Synthetic oligonucleotide
gtcgacataacgcgtata

SEQ ID NO: 1388 - DNA, 1482 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaacctgctagctccatgcttgcctgtgacctggtaagcatggagctagcaggttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1389 - DNA, 14 bp, Artificial Sequence
  Description of Artificial Sequence: Synthetic oligonucleotide
ctcgagagatctac

SEQ ID NO: 1390 - DNA, 3013 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcaggttgttcattggtcgcctttagttttccaaaataagtgtcactttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagcccctgcctggctttgctgtttgcccaccgtcccgtgtcagtgaatcacgggcatcttcaggagctcagcctgggtcttcatttgtttccctcggccccttcctcagcctcaggacagtgctgcagcccccacacattcttccctacagataccatggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcggcagctggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccttgggcactggatattgggaagggacagtgtccacactggagtgggaagttcccagggacgagacctttacctcctcaccctgggtactgttctcctcatggagcatggacggcgctgcctgaactcagtggtggcctcattctggaagccaagtttatacagagtagcagtgacccagggatgtggggttcaccctcctcagccctctggccagtcctgatgggcctcagtcccaacatggctaagaggtgtgggcagcttcttggtcaccctcaggttggggaatcaccttctgtcttcattttccaggaacttggtgatgatatcgtgggtgagttcatttaccaggtgctgtagtttcccctcatcaggcaggaagaagatggcggtggcattgcccaggtatttcatcagcagcacccagctggacagcttcttacagtgctggatgttaaacatgcctaaacgcttcatcataggcaccttcacggtggtcacctggtccacgtggaagtcctcttcctcggtgtccttgacttcaaagggtctctcccatttgcctggagagaggggaaggtgggcatcaccaggggtgagtgaaggtttggaagagtgtagcagaataagaaaccatgagtcccctccctgagaagccctgagcccccttgacgacacacatccctcgaggctcagcttcatcatctgtaaaaggtgctgaaactgacc

SEQ ID NO: 1391 - DNA, 712 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccacgcgt

SEQ ID NO: 1392 - DNA, 2405 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcagttgttcattggtcgcctttagttttccaaaataagtgtcatctttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagtcccctgcctggctttgctgtttgaccacgtcccgtgtcagtgaatcacgggcatcttcaggagctcagcctgggtcttcatttgtttccctcggccccttcctcagcctcaggacagagctgcagcccccacacattcttccctacagataccagggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatgggggagacaatgccaccctgagcagggtctggtgtgagcgggcagcttggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccctgggcactggatattgggaagggacagtgtccacactggagtgggaagtccccagggacgagacctttacctcctcacccctgggtactgttctcctcatggagcatggacgcgt

SEQ ID NO: 1393 - DNA, 1203 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcagttgttcattggtcgcctttagttttccaaaataagtgtcatctttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagtcccctgcctggctttgctgtttgaccacgtcccgtgtcagtgaatcacgggcatcttcaggagctcagcctgggtcttcatttgtttccctcggccccttcctcagcctcaggacagagctgcagcccccacacattcttccctacagataccagggtgcaacaaggtcgtcagggtgatctcaccttggagagcttcaggggtgcctccacgcgt

SEQ ID NO: 1394 - DNA, 103 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttctacgcgt

SEQ ID NO: 1395 - DNA, 55 bp, Artificial Sequence
  Description of Artificial Sequence: Synthetic oligonucleotide
aattcgcccttgggcctaggcaattggatccgccggcagagaaaacatcacgcgt

SEQ ID NO: 1396 - DNA, 1512 bp, Artificial Sequence
  Description of Artificial Sequence: Synthetic oligonucleotide
cgcgtaattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcagttgttcattggtcgcctttagttttccaaaataagtgtcatctttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagtcccctgcctggctttgctgtttgaccacgtcccgtgtcagtgaatcacgggcatcttcaggagctcagcctgggtcttcatttgtttccctcggccccttcctcagcctcaggacagagctgcagcccccacacattcttccctacagataccatggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaaga

SEQ ID NO: 1397 - DNA, 363 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggagggacgcgt

SEQ ID NO: 1398 - DNA, 2395 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcaggttgttcattggtcgcctttagttttccaaaataagtgtcactttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagcccctgcctggctttgctgtttgcccaccgtcccgtgtcagtgaatcacgggcatcttcaggagctcagcctgggtcttcatttgtttccctcggccccttcctcagcctcaggacagtgctgcagcccccacacattcttccctacagataccatggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcggcagctggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccttgggcactggatattgggaagggacagtgtccacactggagtgggaagttcccagggacgagacctttacctcctcaccctgggtactgttctcctcatggagcatgg

SEQ ID NO: 1399 - DNA, 97 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttct

SEQ ID NO: 1400 - DNA, 714 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccatttaaat

SEQ ID NO: 1401 - DNA, 3021 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcaggttgttcattggtcgcctttagttttccaaaataagtgtcactttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagcccctgcctggctttgctgtttgcccaccgtcccgtgtcagtgaatcacgggcatcttcaggagctcagcctgggtcttcatttgtttccctcggccccttcctcagcctcaggacagtgctgcagcccccacacattcttccctacagataccatggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcggcagctggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccttgggcactggatattgggaagggacagtgtccacactggagtgggaagttcccagggacgagacctttacctcctcaccctgggtactgttctcctcatggagcatggacggcgctgcctgaactcagtggtggcctcattctggaagccaagtttatacagagtagcagtgacccagggatgtggggttcaccctcctcagccctctggccagtcctgatgggcctcagtcccaacatggctaagaggtgtgggcagcttcttggtcaccctcaggttggggaatcaccttctgtcttcattttccaggaacttggtgatgatatcgtgggtgagttcatttaccaggtgctgtagtttcccctcatcaggcaggaagaagatggcggtggcattgcccaggtatttcatcagcagcacccagctggacagcttcttacagtgctggatgttaaacatgcctaaacgcttcatcataggcaccttcacggtggtcacctggtccacgtggaagtcctcttcctcggtgtccttgacttcaaagggtctctcccatttgcctggagagaggggaaggtgggcatcaccaggggtgagtgaaggtttggaagagtgtagcagaataagaaaccatgagtcccctccctgagaagccctgagcccccttgacgacacacatccctcgaggctcagcttcatcatctgtaaaaggtgctgaaactgaccatttaaat

SEQ ID NO: 1402 - DNA, 1209 bp, Artificial Sequence
  Description of Artificial Sequence: Synthetic oligonucleotide
tctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcgggcagcttggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccctgggcactggatattgggaagggacagtgtccacactggagtgggaagtccccagggacgagacctttacctcctcacccctgggtactgttctcctcatggagcatggatttaaat

SEQ ID NO: 1403 - DNA, 56 bp, Artificial Sequence
  Description of Artificial Sequence: Synthetic oligonucleotide
ccagggatttacagatcacatgcaggcagggaccagctcaactcttctatttaaat

SEQ ID NO: 1404 - DNA, 1519 bp, Artificial Sequence
  Description of Artificial Sequence: Synthetic oligonucleotide
aatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcgggcagcttggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccctgggcactggatattgggaagggacagtgtccacactggagtgggaagtccccagggacgagacctttacctcctcacccctgggtactgtcctcctcatggagcatggatggcgctgcctgaactcagtggtggcctcattctggaagccaagtttatacagagtagcagtgacccagggatgtggggttcaccctcctcagccctctggccagtcctgatgggcctcagtcccaacatggctaagaggtgtgggcagcttcttggtcaccctcaggttggggaatcaccttctgtcttcattttccaggaacttggtgatgatatcgtgggtgagttcattttccaggtgctgtagtttcccctcatcaggcaggaagaagatggcggtggcattgcccaggtatttcatcagcagcacccagctggacagcttcttacagtgctggatgttaaacatgcctaaacgcttcatcataggcaccttcacggtggtcacctggtccacgtggaagtcctcttcctcggtgtccttgacttcaaagggtctctcccatttgcctggagagaggggaaggtgggcatcaccaggggtgagtgaaggtttggaagagtgtagcagaataaagaaaccatgagtcccctccctgagaagccctgagcccccttgacgacacacatccctcgaggctcagcttcatcatctgtaaaaggtgctgaaactgaccatttaaat

SEQ ID NO: 1405 - DNA, 357 bp, Artificial Sequence
  Description of Artificial Sequence: Synthetic oligonucleotide
gagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccatttaaat

SEQ ID NO: 1406 - DNA, 2403 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcaggttgttcattggtcgcctttagttttccaaaataagtgtcactttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagcccctgcctggctttgctgtttgcccaccgtcccgtgtcagtgaatcacgggcatcttcaggagctcagcctgggtcttcatttgtttccctcggccccttcctcagcctcaggacagtgctgcagcccccacacattcttccctacagataccatggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcggcagctggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccttgggcactggatattgggaagggacagtgtccacactggagtgggaagttcccagggacgagacctttacctcctcaccctgggtactgttctcctcatggagcatggatttaaat

SEQ ID NO: 1407 - DNA, 105 bp, Artificial Sequence
  Description of Artificial Sequence: Synthetic oligonucleotide
aattcgcccttgggcctaggcaattggatccgccggcagagaaaacatcccagggatttacagatcacatgcaggcagggaccagctcaacccttctatttaaat

SEQ ID NO: 1408 - DNA, 382 bp, Artificial Sequence
  Description of Artificial Sequence: Synthetic oligonucleotide
cgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattac

SEQ ID NO: 1409 - DNA, 303 bp, Artificial Sequence
  Description of Artificial Sequence: Synthetic oligonucleotide
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctagtattagtcatcgctattaccatg

SEQ ID NO: 1410 - DNA, 260 bp, Artificial Sequence
  Description of Artificial Sequence: Synthetic oligonucleotide
ccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcggg

SEQ ID NO: 1411 - DNA, 588 bp, Artificial Sequence
  Description of Artificial Sequence: Synthetic oligonucleotide
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctc

SEQ ID NO: 1412 - DNA, 204 bp, Artificial Sequence
  Description of Artificial Sequence: Synthetic oligonucleotide
gtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 1413 - DNA, 219 bp, Artificial Sequence
  Description of Artificial Sequence: Synthetic oligonucleotide
aattcgaacgctgacgtcatcaacccgctccaaggaatcgcgggcccagtgtcactaggcgggaacacccagcgcgcgtgcgccctggcaggaagatggctgtgagggacagggagtggcgccctgcaatatttgcatgtcgctatgtgttctgggaaatcaccataaacgtgaaatgtctttggatttgggaatcttataagttctgtatgagaccac

SEQ ID NO: 1414 - DNA, 17 bp, Artificial Sequence
  Description of Artificial Sequence: Synthetic oligonucleotide
taatacgactcactata

SEQ ID NO: 1415 - DNA, 134 bp, Artificial Sequence
  Description of Artificial Sequence: Synthetic oligonucleotide
tcagatcgcctggagacgccatccacgctgttttgacctccatagaagacaccgggaccgatccagcctccgcggattcgaatcccggccgggaacggtgcattggaacgcggattccccgtgccaagagtgac

SEQ ID NO: 1416 - DNA, 53 bp, Artificial Sequence
  Description of Artificial Sequence: Synthetic oligonucleotide
ctcctgggcaacgtgctggtctgtgtgctggcccatcactttggcaaagaatt

SEQ ID NO: 1417 - DNA, 172 bp, Artificial Sequence
  Description of Artificial Sequence: Synthetic oligonucleotide
gaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtaccc

SEQ ID NO: 1418 - DNA, 32 bp, Artificial Sequence
  Description of Artificial Sequence: Synthetic oligonucleotide
gtaagtaccgcctatagagtctataggcccac

SEQ ID NO: 1419 - DNA, 347 bp, Artificial Sequence
  Description of Artificial Sequence: Synthetic oligonucleotide
aaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatttctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacag

SEQ ID NO: 1420 - DNA, 127 bp, Artificial Sequence
  Description of Artificial Sequence: Synthetic oligonucleotide
gatctttttccctctgccaaaaattatggggacatcatgaagccccttgagcatctgacttctggctaataaaggaaatttattttcattgcaatagtgtgttggaattttttgtgtctctcactcg

SEQ ID NO: 1421 - DNA, 225 bp, Artificial Sequence
  Description of Artificial Sequence: Synthetic oligonucleotide
ctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgg

SEQ ID NO: 1422 - DNA, 477 bp, Artificial Sequence
  Description of Artificial Sequence: Synthetic oligonucleotide
gggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtcctt

SEQ ID NO: 1423 - DNA, 476 bp, Artificial Sequence
  Description of Artificial Sequence: Synthetic oligonucleotide
gggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtcct

SEQ ID NO: 1424 - protein, 3137 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEETERTQINVLAVQAITSLVLSAMTVPVAGNPAVSCLEQQPRNKPLKALTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 1425 - DNA, 13669 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcagcgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctaaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatcaaaaaaaaaaaaaaaaaa

SEQ ID NO: 1426 - DNA, 1482 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaagcaattcagtctcgttgtccctgtgacctggtacaacgagactgaattgcttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1427 - DNA, 1482 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaatgaacctcttgttataaagcctgtgacctggttttataacaagaggttcattctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1428 - DNA, 1482 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaaccgacaaccagtatttgggcctgtgacctggtccaaatactggttgtcggttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1429 - DNA, 1482 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaaccacaatgttgtgactgggcctgtgacctggtccggtcacaacattgtggttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1430 - DNA, 1482 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaagcaattcagtctcgttgtacctgtgatttggtacaacgagactgaattgcttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1431 - DNA, 1482 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaagcaattcagactcgttgtacctgtgacctggtacaacgagactgaattgcttctgtggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1432 - DNA, 1482 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcttcggaagcaattcagtctcgttgtacctgtgacctggtacaacgagactgaattgcttctgtggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1433 - DNA, 1584 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgaagcaaagaaggggcagagggagcccgtgagctgagtgggccagggactgggagaaggagtgaggaggcagggccggcatgcctctgctgctggccagagcaattcagtctcgttgtaccgtctgcacctgtcactagtacaacgagactgaattgctttggccgtgtagtgctacccagcgctggctgcctcctcagcattgcaattcctctcccatctgggcaccagtcagctaccctggtgggaatctgggtagccctcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1434 - DNA, 1584 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgaagcaaagaaggggcagagggagcccgtgagctgagtgggccagggactgggagaaggagtgaggaggcagggccggcatgcctctgctgctggccagaggtttatgaactgacgttaccgtctgcacctgtcactagtaacgtcagttcataaacctttggccgtgtagtgctacccagcgctggctgcctcctcagcattgcaattcctctcccatctgggcaccagtcagctaccctggtgggaatctgggtagccctcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1435 - DNA, 1584 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgaagcaaagaaggggcagagggagcccgtgagctgagtgggccagggactgggagaaggagtgaggaggcagggccggcatgcctctgctgctggccagaccgacaaccagtatttggaccgtctgcacctgtcactagtccaaatactggttgtcggtttggccgtgtagtgctacccagcgctggctgcctcctcagcattgcaattcctctcccatctgggcaccagtcagctaccctggtgggaatctgggtagccctcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1436 - DNA, 1584 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgaagcaaagaaggggcagagggagcccgtgagctgagtgggccagggactgggagaaggagtgaggaggcagggccggcatgcctctgctgctggccagaccacaatgttgtgactggaccgtctgcacctgtcactagtccggtcacaacattgtggtttggccgtgtagtgctacccagcgctggctgcctcctcagcattgcaattcctctcccatctgggcaccagtcagctaccctggtgggaatctgggtagccctcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1437 - DNA, 1487 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctccacggaacctgctagctccatgcttgctgtggccactgagaagtaagcatggagctagcaggttctgaggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1438 - DNA, 1487 bp, Artificial Sequence
  Description of Artificial Sequence: Synthetic polynucleotide
ctgcgcgctcgctcgctcactgaggccgcccgggcaaagcccgggcgtcgggcgacctttggtcgcccggcctcagtgagcgagcgagcgcgcagagagggagtgtagccatgctctaggaagatcaattcaattcacgcgtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagcttgaactgaaaaaccagaaagttaactggtaagtttagtctttttgtcttttatttcaggtcccggatccggtggtggtgcaaatcaaagaactgctcctcagtggatgttgcctttacttctaggcctgtacggaagtgttacttctgctctaaaagctgcggaattgtacccgcggccgatccaccggtgtgctgggcggggggcggcgggccctcccgcagaacaccatgcgctcctcggaataagcatggagctagcaggttgtggccactgagaaacctgctagctccatgcttgttctgcggagcgccttgacagcagccatgggagggccgccccctacctcagtgactcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggcctaggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 1439 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 1440 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQQAVRTSLAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 1441 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 1442 - protein, 11 aa, Artificial Sequence
  Description of Artificial Sequence: Synthetic polypeptide
AQTLAVPFKAQ

SEQ ID NO: 1443 - protein, 11 aa, Artificial Sequence
  Description of Artificial Sequence: Synthetic polypeptide
AQSVSKPFLAQ

SEQ ID NO: 1444 - protein, 11 aa, Artificial Sequence
  Description of Artificial Sequence: Synthetic polypeptide
AQFTLTTPKAQ

SEQ ID NO: 1445 - protein, 11 aa, Artificial Sequence
  Description of Artificial Sequence: Synthetic polypeptide
DGTLAVPFKAQ

SEQ ID NO: 1446 - protein, 11 aa, Artificial Sequence
  Description of Artificial Sequence: Synthetic polypeptide
ESTLAVPFKAQ

SEQ ID NO: 1447 - protein, 11 aa, Artificial Sequence
  Description of Artificial Sequence: Synthetic polypeptide
GGTLAVPFKAQ

SEQ ID NO: 1448 - protein, 11 aa, Artificial Sequence
  Description of Artificial Sequence: Synthetic polypeptide
AQTLATPFKAQ

SEQ ID NO: 1449 - protein, 11 aa, Artificial Sequence
  Description of Artificial Sequence: Synthetic polypeptide
ATTLATPFKAQ

SEQ ID NO: 1450 - protein, 11 aa, Artificial Sequence
  Description of Artificial Sequence: Synthetic polypeptide
DGTLATPFKAQ

SEQ ID NO: 1451 - protein, 11 aa, Artificial Sequence
  Description of Artificial Sequence: Synthetic polypeptide
GGTLATPFKAQ

SEQ ID NO: 1452 - protein, 11 aa, Artificial Sequence
  Description of Artificial Sequence: Synthetic polypeptide
SGSLAVPFKAQ

SEQ ID NO: 1453 - protein, 11 aa, Artificial Sequence
  Description of Artificial Sequence: Synthetic polypeptide
AQTLAQPFKAQ

SEQ ID NO: 1454 - protein, 11 aa, Artificial Sequence
  Description of Artificial Sequence: Synthetic polypeptide
AQTLQQPFKAQ

SEQ ID NO: 1455 - protein, 11 aa, Artificial Sequence
  Description of Artificial Sequence: Synthetic polypeptide
AQTLSNPFKAQ

SEQ ID NO: 1456 - protein, 11 aa, Artificial Sequence
  Description of Artificial Sequence: Synthetic polypeptide
AQTLAVPFSNP

SEQ ID NO: 1457 - protein, 11 aa, Artificial Sequence
  Description of Artificial Sequence: Synthetic polypeptide
QGTLAVPFKAQ

SEQ ID NO: 1458 - protein, 11 aa, Artificial Sequence
  Description of Artificial Sequence: Synthetic polypeptide
NQTLAVPFKAQ

SEQ ID NO: 1459 - protein, 11 aa, Artificial Sequence
  Description of Artificial Sequence: Synthetic polypeptide
EGSLAVPFKAQ

SEQ ID NO: 1460 - protein, 11 aa, Artificial Sequence
  Description of Artificial Sequence: Synthetic polypeptide
SGNLAVPFKAQ

SEQ ID NO: 1461 - protein, 11 aa, Artificial Sequence
  Description of Artificial Sequence: Synthetic polypeptide
EGTLAVPFKAQ

SEQ ID NO: 1462 - protein, 11 aa, Artificial Sequence
  Description of Artificial Sequence: Synthetic polypeptide
DSTLAVPFKAQ

SEQ ID NO: 1463 - protein, 11 aa, Artificial Sequence
  Description of Artificial Sequence: Synthetic polypeptide
AVTLAVPFKAQ

SEQ ID NO: 1464 - protein, 11 aa, Artificial Sequence
  Description of Artificial Sequence: Synthetic polypeptide
AQTLSTPFKAQ

SEQ ID NO: 1465 - protein, 11 aa, Artificial Sequence
  Description of Artificial Sequence: Synthetic polypeptide
AQTLPQPFKAQ

SEQ ID NO: 1466 - protein, 11 aa, Artificial Sequence
  Description of Artificial Sequence: Synthetic polypeptide
AQTLSQPFKAQ

SEQ ID NO: 1467 - protein, 11 aa, Artificial Sequence
  Description of Artificial Sequence: Synthetic polypeptide
AQTLQLPFKAQ

SEQ ID NO: 1468 - protein, 11 aa, Artificial Sequence
  Description of Artificial Sequence: Synthetic polypeptide
AQTLTMPFKAQ

SEQ ID NO: 1469 - protein, 11 aa, Artificial Sequence
  Description of Artificial Sequence: Synthetic polypeptide
AQTLTTPFKAQ

SEQ ID NO: 1470 - protein, 11 aa, Artificial Sequence
  Description of Artificial Sequence: Synthetic polypeptide
AQYTLSQGWAQ

SEQ ID NO: 1471 - protein, 11 aa, Artificial Sequence
  Description of Artificial Sequence: Synthetic polypeptide
AQMNATKNVAQ

SEQ ID NO: 1472 - protein, 11 aa, Artificial Sequence
  Description of Artificial Sequence: Synthetic polypeptide
AQVSGGHHSAQ

SEQ ID NO: 1473 - protein, 11 aa, Artificial Sequence
  Description of Artificial Sequence: Synthetic polypeptide
AQTLTAPFKAQ

SEQ ID NO: 1474 - protein, 11 aa, Artificial Sequence
  Description of Artificial Sequence: Synthetic polypeptide
AQTLSKPFKAQ

SEQ ID NO: 1475 - protein, 7 aa, Artificial Sequence
  Description of Artificial Sequence: Synthetic polypeptide
QAVRTSL

SEQ ID NO: 1476 - protein, 7 aa, Artificial Sequence
  Description of Artificial Sequence: Synthetic polypeptide
LAKERLS

SEQ ID NO: 1477 - protein, 7 aa, Artificial Sequence
  Description of Artificial Sequence: Synthetic polypeptide
MNSTKNV

SEQ ID NO: 1478 - protein, 7 aa, Artificial Sequence
  Description of Artificial Sequence: Synthetic polypeptide
VSGGHHS

SEQ ID NO: 1479 - protein, 14 aa, Artificial Sequence
  Description of Artificial Sequence: Synthetic polypeptide
SAQTLAVPFKAQAQ

SEQ ID NO: 1480 - protein, 14 aa, Artificial Sequence
  Description of Artificial Sequence: Synthetic polypeptide
  MOD_RES (2)..(4): Xaa = any amino acid
SXXXLAVPFKAQAQ

SEQ ID NO: 1481 - protein, 14 aa, Artificial Sequence
  Description of Artificial Sequence: Synthetic polypeptide
  MOD_RES (4)..(6): Xaa = any amino acid
SAQXXXVPFKAQAQ

SEQ ID NO: 1482 - protein, 14 aa, Artificial Sequence
  Description of Artificial Sequence: Synthetic polypeptide
  MOD_RES (6)..(8): Xaa = any amino acid
SAQTLXXXFKAQAQ

SEQ ID NO: 1483 - protein, 14 aa, Artificial Sequence
  Description of Artificial Sequence: Synthetic polypeptide
  MOD_RES (8)..(10): Xaa = any amino acid
SAQTLAVXXXAQAQ

SEQ ID NO: 1484 - protein, 14 aa, Artificial Sequence
  Description of Artificial Sequence: Synthetic polypeptide
  MOD_RES (10)..(12): Xaa = any amino acid
SAQTLAVPFXXXAQ

SEQ ID NO: 1485 - protein, 7 aa, Artificial Sequence
  Description of Artificial Sequence: Synthetic polypeptide
TNHQSAQ

SEQ ID NO: 1486 - protein, 7 aa, Artificial Sequence
  Description of Artificial Sequence: Synthetic polypeptide
AQAQTGW

SEQ ID NO: 1487 - protein, 9 aa, Artificial Sequence
  Description of Artificial Sequence: Synthetic polypeptide
DGTLATPFK

SEQ ID NO: 1488 - protein, 11 aa, Artificial Sequence
  Description of Artificial Sequence: Synthetic polypeptide
  MOD_RES (10)..(11): Xaa = any amino acid
DGTLATPFKXX

SEQ ID NO: 1489 - protein, 8 aa, Artificial Sequence
  Description of Artificial Sequence: Synthetic polypeptide
LAVPFKAQ

SEQ ID NO: 1490 - protein, 6 aa, Artificial Sequence
  Description of Artificial Sequence: Synthetic polypeptide
VPFKAQ

SEQ ID NO: 1491 - protein, 4 aa, Artificial Sequence
  Description of Artificial Sequence: Synthetic polypeptide
FKAQ

SEQ ID NO: 1492 - protein, 6 aa, Artificial Sequence
  Description of Artificial Sequence: Synthetic polypeptide
AQTLAV

SEQ ID NO: 1493 - protein, 8 aa, Artificial Sequence
  Description of Artificial Sequence: Synthetic polypeptide
AQTLAVPF

SEQ ID NO: 1494 - protein, 4 aa, Artificial Sequence
  Description of Artificial Sequence: Synthetic polypeptide
QAVR

SEQ ID NO: 1495 - protein, 4 aa, Artificial Sequence
  Description of Artificial Sequence: Synthetic polypeptide
AVRT

SEQ ID NO: 1496 - protein, 4 aa, Artificial Sequence
  Description of Artificial Sequence: Synthetic polypeptide
VRTS

SEQ ID NO: 1497 - protein, 4 aa, Artificial Sequence
  Description of Artificial Sequence: Synthetic polypeptide
RTSL

SEQ ID NO: 1498 - protein, 5 aa, Artificial Sequence
  Description of Artificial Sequence: Synthetic polypeptide
QAVRT

SEQ ID NO: 1499 - protein, 5 aa, Artificial Sequence
  Description of Artificial Sequence: Synthetic polypeptide
AVRTS

SEQ ID NO: 1500 - protein, 5 aa, Artificial Sequence
  Description of Artificial Sequence: Synthetic polypeptide
VRTSL

SEQ ID NO: 1501 - protein, 6 aa, Artificial Sequence
  Description of Artificial Sequence: Synthetic polypeptide
QAVRTS

SEQ ID NO: 1502 - protein, 6 aa, Artificial Sequence
  Description of Artificial Sequence: Synthetic polypeptide
AVRTSL

SEQ ID NO: 1503 - DNA, 33 bp, Artificial Sequence
  Description of Artificial Sequence: Synthetic polynucleotide
gatgggactttggcggtgccttttaaggcacag

SEQ ID NO: 1504 - DNA, 33 bp, Artificial Sequence
  Description of Artificial Sequence: Synthetic polynucleotide
gatgggacgttggcggtgccttttaaggcacag

SEQ ID NO: 1505 - DNA, 21 bp, Artificial Sequence
  Description of Artificial Sequence: Synthetic polynucleotide
caggcggttaggacgtctttg

SEQ ID NO: 1506 - DNA, 27 bp, Artificial Sequence
  Description of Artificial Sequence: Synthetic polynucleotide
caggtcttcacggactcagactatcag

SEQ ID NO: 1507 - DNA, 32 bp, Artificial Sequence
  Description of Artificial Sequence: Synthetic polynucleotide
caagtaaaacctctacaaatgtggtaaaatcg

SEQ ID NO: 1508 - DNA, 36 bp, Artificial Sequence
  Description of Artificial Sequence: Synthetic polynucleotide
actcatcgaccaatacttgtactatctctctagaac

SEQ ID NO: 1509 - DNA, 26 bp, Artificial Sequence
  Description of Artificial Sequence: Synthetic polynucleotide
ggaagtattccttggttttgaaccca

SEQ ID NO: 1510 - DNA, 23 bp, Artificial Sequence
  Description of Artificial Sequence: Synthetic polynucleotide
ggtcgcggttcttgtttgtggat

SEQ ID NO: 1511 - DNA, 24 bp, Artificial Sequence
  Description of Artificial Sequence: Synthetic polynucleotide
cgaccttgaagcgcatgaactcct

SEQ ID NO: 1512 - DNA, 83 bp, Artificial Sequence
  Description of Artificial Sequence: Synthetic polynucleotide
  misc_feature (42)..(43): n = a, c, t or g
  misc_feature (45)..(46): n = a, c, t or g
  misc_feature (48)..(49): n = a, c, t or g
  misc_feature (51)..(52): n = a, c, t or g
  misc_feature (54)..(55): n = a, c, t or g
  misc_feature (57)..(58): n = a, c, t or g
  misc_feature (60)..(61): n = a, c, t or g
gtattccttggttttgaacccaaccggtctgcgcctgtgcmnnmnnmnnmnnmnnmnnmnnttgggcactctggtggtttgtc

SEQ ID NO: 1513 - DNA, 64 bp, Artificial Sequence
  Description of Artificial Sequence: Synthetic polynucleotide
  misc_feature (36)..(37): n = a, c, t or g
  misc_feature (39)..(40): n = a, c, t or g
  misc_feature (42)..(43): n = a, c, t or g
gtattccttggttttgaacccaaccggtctgcgcmnnmnnmnnaaaaggcaccgccaaagtttg

SEQ ID NO: 1514 - DNA, 70 bp, Artificial Sequence
  Description of Artificial Sequence: Synthetic polynucleotide
  misc_feature (42)..(43): n = a, c, t or g
  misc_feature (45)..(46): n = a, c, t or g
  misc_feature (48)..(49): n = a, c, t or g
gtattccttggttttgaacccaaccggtctgcgcctgtgcmnnmnnmnncaccgccaaagtttgggcact

SEQ ID NO: 1515 - DNA, 77 bp, Artificial Sequence
  Description of Artificial Sequence: Synthetic polynucleotide
  misc_feature (48)..(49): n = a, c, t or g
  misc_feature (51)..(52): n = a, c, t or g
  misc_feature (54)..(55): n is a, c, g, or t
gtattccttggttttgaacccaaccggtctgcgcctgtgccttaaamnnmnnmnncaaagtttgggcactctggtgg

SEQ ID NO: 1516 - DNA, 83 bp, Artificial Sequence
  Description of Artificial Sequence: Synthetic polynucleotide
  misc_feature (54)..(55): n = a, c, t or g
  misc_feature (57)..(58): n = a, c, t or g
  misc_feature (60)..(61): n = a, c, t or g
gtattccttggttttgaacccaaccggtctgcgcctgtgccttaaaaggcacmnnmnnmnnttgggcactctggtggtttgtg

SEQ ID NO: 1517 - DNA, 21 bp, Artificial Sequence
  Description of Artificial Sequence: Synthetic polynucleotide
cttgcgaaggagcggctttcg

SEQ ID NO: 1518 - protein, 534 aa, Artificial Sequence
  Description of Artificial Sequence: Synthetic polypeptide
MAEGGGGAMGDSSGGADGVGNASGNWHCDSQWMGNTVITKTTRTWVLPSYNNHIYKAITSGTSQDANVQYAGYSTPWGYFDFNRFHCHFSPRDWQRLINNHWGIRPKSLKFKIFNVQVKEVTTQDQTKTIANNLTSTIQVFTDDEHQLPYVLGSATEGTMPPFPSDVYALPQYGYCTMHTNQNGARFNDRSAFYCLEYFPSQMLRTGNNFEFTFDFEEVPFHSMFAHSQDLDRLMNPLVDQYLWNFNEVDSSRNAQFKKAVKGAYGTMGRNWLPGPKFLDQRVRAYTGGTDNYANWNIWSNGNKVNLKDRQYLLQPGPVSATYTEGEASSLPAQNILGIAKDPYRSGSTTAGISDIMVTEEQEVAPTNGVGWKPYGRTVTNEQNTTTAPTSSDLDVLGALPGMVWQNRDIYLQGPIGAKIPKTDGKFHPSPNLGGFGLHNPPPQVFIKNTPVPADPPVEYVHQKWNSYITQYSTGQCTVEMVWELRKENSKRWNPEIQFTSNFSNRTSIMFAPNETGGYVEDRLIGTRYLTQNL

SEQ ID NO: 1519 - protein, 554 aa, Artificial Sequence
  Description of Artificial Sequence: Synthetic polypeptide
MTSVNSAEASTGAGGGGSNPVKSMWSEGATFSANSVTCTFSRQFLIPYDPEHHYKVFSPAASSCHNASGKEAKVCTISPIMGYSTPWRYLDFNALNLFFSPLEFQHLIENYGSIAPDALTVTISEIAVKDVTDKTGGGVQVTDSTTGRLCMLVDHEYKYPYVLGQGQDTLAPELPIWVYFPPQYAYLTVGDVNTQGISGDSKKLASEESAFYVLEHSSFQLLGTGGTATMSYKFPPVPPENLEGCSQHFYEMYNPLYGSRLGVPDTLGGDPKFRSLTHEDHAIQPQNFMPGPLVNSVSTKEGDSFNTGAGKALTGLSTGTSQNTRISLRPGPVSQPYHHWDTDKYVTGINAISHGQTTYGNAEDKEYQQGVGRFPNEKEQLKQLQGLNMHTYFPNKGTQQYTDQIERPLMVGSVWNRRALHYESQLWSKIPNLDDSFKTQFAALGGWGLHQPPPQIFLKILPQSGPIGGIKSMGITTLVQYAVGIMTVTMTFKLGPRKATGRWNPQPGVYPPHAAGHLPYVLYDPTATDAKQHHRHGYEKPEELWTAKSRVHPL

SEQ ID NO: 1520 - protein, 587 aa, Artificial Sequence
  Description of Artificial Sequence: Synthetic polypeptide
MSDGTSQPDGGNAVHSAARVERAADGPGGSGGGGSGGGGVGVSTGSYDNQTHYRFLGDGWVEITALATRLVHLNMPKSENYCRIRVHNTTDTSVKGNMAKDDAHEQIWTPWSLVDANAWGVWLQPSDWQYICNTMSQLNLVSLDQEIFNVVLKTVTEQDSGGQAIKIYNNDLTACMMVAVDSNNILPYTPAANSMETLGFYPWKPTIASPYRYYFCVDRDLSVTYENQEGTIEHNVMGTPKGMNSQFFTIENTQQITLLRTGDEFATGTYYFDTNPVKLTHTWQTNRQLGQPPLLSTFPEADTDAGTLTAQGSRHGATQMEVNWVSEAIRTRPAQVGFCQPHNDFEASRAGPFAAPKVPADVTQGMDREANGSVRYSYGKQHGENWAAHGPAPERYTWDETNFGSGRDTRDGFIQSAPLVVPPPLNGILTNANPIGTKNDIHFSNVFNSYGPLTTFSHPSPVYPQGQIWDKELDLEHKPRLHITAPFVCKNNAPGQMLVRLGPNLTDQYDPNGATLSRIVTYGTFFWKGKLTMRAKLRANTTWNPVYQVSVEDNGNSYMSVTKWLPTATGNMQSVPLITRPVARNTY

SEQ ID NO: 1521 - protein, 584 aa, Artificial Sequence
  Description of Artificial Sequence: Synthetic polypeptide
MSDGAVQPDGGQPAVRNERATGSGNGSGGGGGGGSGGVGISTGTFNNQTEFKFLENGWVEITANSSRLVHLNMPESENYKRVVVNNMDKTAVKGNMALDDIHVEIVTPWSLVDANAWGVWFNPGDWQLIVNTMSELHLVSFEQEIFNVVLKTVSESATQPPTKVYNNDLTASLMVALDSNNTMPFTPAAMRSETLGFYPWKPTIPTPWRYYFQWDRTLIPSHTGTSGTPTNVYHGTDPDDVQFYTIENSVPVHLLRTGDEFATGTFFFDCKPCRLTHTWQTNRALGLPPFLNSLPQSEGATNFGDIGVQQDKRRGVTQMGNTDYITEATIMRPAEVGYSAPYYSFEASTQGPFKTPIAAGRGGAQTDENQAADGDPRYAFGRQHGQKTTTTGETPERFTYIAHQDTGRYPEGDWIQNINFNLPVTNDNVLLPTDPIGGKTGINYTNIFNTYGPLTALNNVPPVYPNGQIWDKEFDTDLKPRLHINAPFVCQNNCPGQLFVKVAPNLTNQYDPDASANMSRIVTYSDFWWKGKLVFKAKLRASHTWNPIQQMSINVDNQFNYVPNNIGAMKIVYEKSQLAPRKLY

SEQ ID NO: 1522 - protein, 548 aa, Artificial Sequence
  Description of Artificial Sequence: Synthetic polypeptide
GVGISTGTFNNQTEFKFLENGWVEITANSSRLVHLNMPESENYRRVVVNNMDKTAVNGNMALDDIHAQIVTPWSLVDANAWGVWFNPGDWQLIVNTMSELHLVSFEQEIFNVVLKTVSESATQPPTKVYNNDLTASLMVALDSNNTMPFTPAAMRSETLGFYPWKPTIPTPWRYYFQWDRTLIPSHTGTSGTPTNIYHGTDPDDVQFYTIENSVPVHLLRTGDEFATGTFFFDCKPCRLTHTWQTNRALGLPPFLNSLPQSEGATNFGDIGVQQDKRRGVTQMGNTNYITEATIMRPAEVGYSAPYYSFEASTQGPFKTPIAAGRGGAQTDENQAADGNPRYAFGRQHGQKTTTTGETPERFTYIAHQDTGRYPEGDWIQNINFNLPVTNDNVLLPTDPIGGKTGINYTNIFNTYGPLTALNNVPPVYPNGQIWDKEFDTDLKPRLHVNAPFVCQNNCPGQLFVKVAPNLTNEYDPDASANMSRIVTYSDFWWKGKLVFKAKLRASHTWNPIQQMSINVDNQFNYVPSNIGGMKIVYEKSQLAPRKLY

SEQ ID NO: 1523 - protein, 736 aa, Artificial Sequence; identical to SEQ ID NO: 101
  Description of Artificial Sequence: Synthetic polypeptide

SEQ ID NO: 1524 - protein, 736 aa, Artificial Sequence; identical to SEQ ID NO: 96
  Description of Artificial Sequence: Synthetic polypeptide

SEQ ID NO: 1525 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 1526 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNVQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQDQSGSAQNKDLLFSRGSPAGMSVQPKNWLPGPCYRQQRVSKTKTDNNNSNFTWTGASKYNLNGRESIINPGTAMASHKDDKNKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1527 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRVLEPLGLVEEGAKTAPGKKRPVEPSPQRSPDSSTGIGKKGQQPARKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATEDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRNL

SEQ ID NO: 1528 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNVQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQDQSGSAQNKDLLFSRGSPAGMSVQPKNWLPGPCYRQQRVSKTKTDNNNSNFTWTGASKYNLNGRESIINPGTAMASHKDDKNKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1529 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNVQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQDQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1530 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQDQSGSAQNKDLLFSRGSPAGMSVQPKNWLPGPCYRQQRVSKTKTDNNNSNFTWTGASKYNLNGRESIINPGTAMASHKDDKNKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1531 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNVQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1532 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNVQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKNKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1533 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctccaagcgggtgacaatccgtacctgcggtataatcacgccgacgccgagtttcaggagcgtctgcaagaagatacgtcttttgggggcaacctcgggcgcgcagtcttccaggccaaaaagcgggttctcgaacctctgggcctggttgaatcgccggttaagacggctcctggaaagaagagaccggtagagccatcaccccagcgctctccagactcctctacgggcatcggcaagaaaggccagcagcccgcaaaaaagagactcaattttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgcacctgggccctgcccacctacaacaaccacctctacaagcaaatctccaacgggacctcgggaggaagcaccaacgacaacacctacttcggctacagcaccccctgggggtattttgacttcaacagattccactgccacttttcaccacgtgactggcagcgactcatcaacaacaactggggattccggcccaagaggctcaacttcaagctcttcaacatccaagtcaaggaggtcacgcagaatgaaggcaccaagaccatcgccaataaccttaccagcacgattcaggtctttacggactcggaataccagctcccgtacgtgctcggctcggcgcaccagggctgcctgcctccgttcccggcggacgtcttcatgattcctcagtacgggtacctgactctgaacaatggcagtcaggctgtgggccggtcgtccttctactgcctggagtactttccttctcaaatgctgagaacgggcaacaactttgaattcagctacaacttcgaggacgtgcccttccacagcagctacgcgcacagccagagcctggaccggctgatgaaccctctcatcgaccagtacttgtactacctgtcccggactcaaagcacgggcggtactgcaggaactcagcagttgctattttctcaggccgggcctaacaacatgtcggctcaggccaagaactggctacccggtccctgctaccggcagcaacgcgtctccacgacactgtcgcagaacaacaacagcaactttgcctggacgggtgccaccaagtatcatctgaatggcagagactctctggtgaatcctggcgttgccatggctacccacaaggacgacgaagagcgattttttccatccagcggagtcttaatgtttgggaaacagggagctggaaaagacaacgtggactatagcagcgtgatgctaaccagcgaggaagaaataaagaccaccaacccagtggccacagaacagtacggcgtggtggccgataacctgcaacagcaaaacgccgctcctattgtaggggccgtcaatagtcaaggagccttacctggcatggtgtggcagaaccgggacgtgtacctgcagggtcccatctgggccaagattcctcatacggacggcaactttcatccctcgccgctgatgggaggctttggactgaagcatccgcctcctcagatcctgattaaaaacacacctgttcccgcggatcctccgaccaccttcaatcaggccaagctggcttctttcatcacgcagtacagtaccggccaggtcagcgtggagatcgagtgggagctgcagaaggagaacagcaaacgctggaacccagagattcagtacacttccaactactacaaatctacaaatgtggactttgctgtcaatactgagggtacttattccgagcctcgccccattggcacccgttacctcacccgtaatctgtaa

SEQ ID NO: 1534 - protein, 738 aa, Artificial Sequence
  Description of Artificial Sequence: Synthetic polypeptide
MAADGYLPDWLEDNLSEGIREWWDLKPGAPKPKANQQKQDNGRGLVLPGYKYLGPFNGLDKGEPVNAADAAALEHDKAYDQQLQAGDNPYLRYNHADAEFQERLQEDTSFGGNLGRAVFQAKKRVLEPLGLVESPVKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYNFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFNQAKLASFITQYSTGQVSVEIEWELQKENSKRWNPEIQYTSNYYKSTNVDFAVNTEGTYSEPRPIGTRYLTRNL

SEQ ID NO: 1535 - protein, 738 aa, Artificial Sequence; identical to SEQ ID NO: 1534
  Description of Artificial Sequence: Synthetic polypeptide

SEQ ID NO: 1536 - DNA, 4472 bp, Artificial Sequence
  Description of Artificial Sequence: Synthetic polynucleotide
ctccatcactaggggtaaccgcgaagcgcctcccacgctgccgcgtcagcgctgacgtaaattacgtcataggggagtggtcctgtattagctgtcacgtgagtgcttttgcgacattttgcgacaccacgtggccattcatggtatatatggccgagtgagcgagcaggatctccattttgaccgcgaaatttgaacgagcagcagccatgccgggcttctacgagatcgtgcttaaggtgccgagcgacctggacgagcacctgccgggcatttctgactcgtttgtgaactgggtggcagagaaggaatgggagctgcccccggattctgacatggatcggaatctgattgagcaggcacccctgaccgtggccgagaagctacagcgcgacttcctggtccaatggcgccgcgtgagtaaggccccggaggccctcttctttgttcagttcgagaagggcgagtcctacttccacctccatattctggtagagaccacgggggtcaaatccatggtgctgggccgcttcctgagtcagattcgggacaagctggtgcagaccatctaccgcgggatcgagccgaccctgcccaactggttcgcggtgacaaagacgcgtaatggcgccggaggggggaacaaggtggtggacgagtgctacatccccaactacctgctgcccaagactcagcccgagctgcagtgggcgtggactaacatggaggagtatataagcgcgtgcttgaacctggccgagcgcaaacggctcgtggcgcagcacctgacccacgtcagccagacccaggagcagaacaaggagaatctgaacccgaattctgacgcgcctgtcatccggtcaaaaacctccgcgcgctacatggagctggtcgggtggctggtggaccggggcatcacctccgagaagcagtggatccaggaggaccaggcctcgtacatctccttcaacgccgcctccaactcgcggtctcagatcaaggccgcgctggacaatgccggcaagatcatggcgctgaccaaatccgcgcccgactacctggtaggccccgctctgcccgcggacattaaatccaaccgcatctaccgcatcctggagctgaatggctacgaccctgcctacgccggttccgtctttctcggctgggcccagaaaaagtttggcaaaaggaacaccatctggctgtttgggccggccaccacgggcaagaccaacatcgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacctccaacaccaacatgtgcgccgtgattgacgggaacagcaccaccttcgagcaccagcagccgttgcaggaccggatgttcaaatttgaacttacccgccgtctggagcacgactttggcaaggtgacaaagcaggaagtcaaagagttcttccgctgggcgcaggatcacgtgaccgaggtggcgcatgagttctacgtcagaaagggtggagctaacaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccctggcgtgtcagaatctcaaccggtcgtcagaaaaaagacgtatcggaaactctgtgcgattcatcatctgctggggcgggcacccgagattgcttgctcggcctgcgacctggtcaacgtggacctggatgactgtgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctccaagcgggtgacaatccgtacctgcggtataatcacgccgacgccgagtttcaggagcgtctgcaagaagatacgtcttttgggggcaacctcgggcgcgcagtcttccaggccaaaaagcgggttctcgaacctctgggcctggttgaatcgccggttaagacggctcctggaaagaagagaccggtagagccatcaccccagcgctctccagactcctctacgggcatcggcaagaaaggccagcagcccgcaaaaaagagactcaattttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgcacctgggccctgcccacctacaacaaccacctctacaagcaaatctccaacgggacctcgggaggaagcaccaacgacaacacctacttcggctacagcaccccctgggggtattttgacttcaacagattccactgccacttttcaccacgtgactggcagcgactcatcaacaacaactggggattccggcccaagaggctcaacttcaagctcttcaacatccaagtcaaggaggtcacgcagaatgaaggcaccaagaccatcgccaataaccttaccagcacgattcaggtctttacggactcggaataccagctcccgtacgtgctcggctcggcgcaccagggctgcctgcctccgttcccggcggacgtcttcatgattcctcagtacgggtacctgactctgaacaatggcagtcaggctgtgggccggtcgtccttctactgcctggagtactttccttctcaaatgctgagaacgggcaacaactttgaattcagctacaacttcgaggacgtgcccttccacagcagctacgcgcacagccagagcctggaccggctgatgaaccctctcatcgaccagtacttgtactacctgtcccggactcaaagcacgggcggtactgcaggaactcagcagttgctattttctcaggccgggcctaacaacatgtcggctcaggccaagaactggctacccggtccctgctaccggcagcaacgcgtctccacgacactgtcgcagaacaacaacagcaactttgcctggacgggtgccaccaagtatcatctgaatggcagagactctctggtgaatcctggcgttgccatggctacccacaaggacgacgaagagcgattttttccatccagcggagtcttaatgtttgggaaacagggagctggaaaagacaacgtggactatagcagcgtgatgctaaccagcgaggaagaaataaagaccaccaacccagtggccacagaacagtacggcgtggtggccgataacctgcaacagcaaaacgccgctcctattgtaggggccgtcaatagtcaaggagccttacctggcatggtgtggcagaaccgggacgtgtacctgcagggtcccatctgggccaagattcctcatacggacggcaactttcatccctcgccgctgatgggaggctttggactgaagcatccgcctcctcagatcctgattaaaaacacacctgttcccgcggatcctccgaccaccttcaatcaggccaagctggcttctttcatcacgcagtacagtaccggccaggtcagcgtggagatcgagtgggagctgcagaaggagaacagcaaacgctggaacccagagattcagtacacttccaactactacaaatctacaaatgtggactttgctgtcaatactgagggtacttattccgagcctcgccccattggcacccgttacctcacccgtaatctgtaattacatgttaatcaataaaccggttaattcgtttcagttgaactttggtctcctgtccttcttatcttatcggttaccatagaaactggttacttattaactgcttggtgcgcttcgcgataaaagacttacgtcatcgggttacccctagtgatgga

SEQ ID NO: 1537 - protein, 738 aa, Artificial Sequence
  Description of Artificial Sequence: Synthetic polypeptide
MAADGYLPDWLEDNLSEGIREWWDLKPGAPKPKANQQKQDNGRGLVLPGYKYLGPFNGLDKGEPVNAADAAALEHDKAYDQQLQAGDNPYLRYNHADAEFQERLQEDTSFGGNLGRAVFQAKKRVLEPLGLVESPVKTAPGKKRPVEPSPQRSPDSSTGIGKKGQQPAKKRLNFGQTGDSESVPDPQPIGEPPAAPSGVGPNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYNFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFNQAKLASFITQYSTGQVSVEIEWELQKENSKRWNPEIQYTSNYYKSTNVDFAVNTEGTYSEPRPIGTRYLTRNL

SEQ ID NO: 1538 - protein, 738 aa, Artificial Sequence
  Description of Artificial Sequence: Synthetic polypeptide
MAADGYLPDWLEDNLSEGIREWWDLKPGAPKPKANQQRQDNGRGLVLPGYRYLGPFNGLDKGEPVNAADAAALEHDRAYDQQLQAGDNPYLRYNHADAEFQERLQEDTSFGGNLGRAVFQAKKRVLEPLGLVESPVRTAPGKKRPVEPSPQRSPDSSTGIGKKGQQPARKRLNFGQTGDSESVPDPQPIGEPPAAPSGVGPNTMAAGGGAPMADNNEGADGVGSSSGNWHCDSTWLGDRVITTSTRTWALPTYNNHLYRQISNGTSGGSTNDNTYFGYSTPWGYFDFNRFHCHFSPRDWQRLINNNWGFRPKRLNFKLFNIQVKEVTQNEGTRTIANNLTSTIQVFTDSEYQLPYVLGSAHQGCLPPFPADVFMIPQYGYLTLNNGSQAVGRSSFYCLEYFPSQMLRTGNNFEFSYNFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHRDDEERFFPSSGVLMFGRQGAGRDNVDYSSVMLTSEEEIRTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFNQAKLASFITQYSTGQVSVEIEWELQKENSKRWNPEIQYTSNYYKSTNVDFAVNTEGTYSEPRPIGTRYLTRNL

SEQ ID NO: 1539 - protein, 738 aa, Artificial Sequence
  Description of Artificial Sequence: Synthetic polypeptide
MAADGYLPDWLEDNLSEGIREWWDLKPGAPKPKANQQRQDNGRGLVLPGYRYLGPFNGLDKGEPVNAADAAALEHDRAYDQQLQAGDNPYLRYNHADAEFQERLQEDTSFGGNLGRAVFQAKKRVLEPLGLVESPVRTAPGKKRPVEPSPQRSPDSSTGIGKRGQQPARKRLNFGQTGDSESVPDPQPIGEPPAAPSGVGPNTMAAGGGAPMADNNEGADGVGSSSGNWHCDSTWLGDRVITTSTRTWALPTYNNHLYRQISNGTSGGSTNDNTYFGYSTPWGYFDFNRFHCHFSPRDWQRLINNNWGFRPKRLNFKLFNIQVKEVTQNEGTRTIANNLTSTIQVFTDSEYQLPYVLGSAHQGCLPPFPADVFMIPQYGYLTLNNGSQAVGRSSFYCLEYFPSQMLRTGNNFEFSYNFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHRDDEERFFPSSGVLMFGKQGAGRDNVDYSSVMLTSEEEIRTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFNQAKLASFITQYSTGQVSVEIEWELQKENSKRWNPEIQYTSNYYKSTNVDFAVNTEGTYSEPRPIGTRYLTRNL

SEQ ID NO: 1540 - protein, 738 aa, Artificial Sequence
  Description of Artificial Sequence: Synthetic polypeptide
MAADGYLPDWLEDNLSEGIREWWDLKPGAPKPKANQQRQDNGRGLVLPGYRYLGPFNGLDKGEPVNAADAAALEHDRAYDQQLQAGDNPYLRYNHADAEFQERLQEDTSFGGNLGRAVFQAKKRVLEPLGLVESPVRTAPGKKRPVEPSPQRSPDSSTGIGKRGQQPAKKRLNFGQTGDSESVPDPQPIGEPPAAPSGVGPNTMAAGGGAPMADNNEGADGVGSSSGNWHCDSTWLGDRVITTSTRTWALPTYNNHLYRQISNGTSGGSTNDNTYFGYSTPWGYFDFNRFHCHFSPRDWQRLINNNWGFRPKRLNFKLFNIQVKEVTQNEGTRTIANNLTSTIQVFTDSEYQLPYVLGSAHQGCLPPFPADVFMIPQYGYLTLNNGSQAVGRSSFYCLEYFPSQMLRTGNNFEFSYNFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHRDDEERFFPSSGVLMFGRQGAGRDNVDYSSVMLTSEEEIRTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFNQAKLASFITQYSTGQVSVEIEWELQKENSKRWNPEIQYTSNYYKSTNVDFAVNTEGTYSEPRPIGTRYLTRNL

SEQ ID NO: 1541 - protein, 738 aa, Artificial Sequence
  Description of Artificial Sequence: Synthetic polypeptide
MAADGYLPDWLEDNLSEGIREWWDLKPGAPKPKANQQRQDNGRGLVLPGYRYLGPFNGLDKGEPVNAADAAALEHDRAYDQQLQAGDNPYLRYNHADAEFQERLQEDTSFGGNLGRAVFQAKKRVLEPLGLVESPVRTAPGKKRPVEPSPQRSPDSSTGIGKRGQQPAKKRLNFGQTGDSESVPDPQPIGEPPAAPSGVGPNTMAAGGGAPMADNNEGADGVGSSSGNWHCDSTWLGDRVITTSTRTWALPTYNNHLYRQISNGTSGGSTNDNTYFGYSTPWGYFDFNRFHCHFSPRDWQRLINNNWGFRPKRLNFKLFNIQVKEVTQNEGTRTIANNLTSTIQVFTDSEYQLPYVLGSAHQGCLPPFPADVFMIPQYGYLTLNNGSQAVGRSSFYCLEYFPSQMLRTGNNFEFSYNFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHRDDEERFFPSSGVLMFGKQGAGRDNVDYSSVMLTSEEEIRTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFNQARLASFITQYSTGQVSVEIEWELQKENSKRWNPEIQYTSNYYKSTNVDFAVNTEGTYSEPRPIGTRYLTRNL

SEQ ID NO: 1542 - protein, 738 aa, Artificial Sequence
  Description of Artificial Sequence: Synthetic polypeptide
MAADGYLPDWLEDNLSEGIREWWDLKPGAPKPKANQQRQDNGRGLVLPGYRYLGPFNGLDKGEPVNAADAAALEHDRAYDQQLQAGDNPYLRYNHADAEFQERLQEDTSFGGNLGRAVFQAKKRVLEPLGLVESPVRTAPGKKRPVEPSPQRSPDSSTGIGKKGQQPAKKRLNFGQTGDSESVPDPQPIGEPPAAPSGVGPNTMAAGGGAPMADNNEGADGVGSSSGNWHCDSTWLGDRVITTSTRTWALPTYNNHLYRQISNGTSGGSTNDNTYFGYSTPWGYFDFNRFHCHFSPRDWQRLINNNWGFRPKRLNFKLFNIQVKEVTQNEGTRTIANNLTSTIQVFTDSEYQLPYVLGSAHQGCLPPFPADVFMIPQYGYLTLNNGSQAVGRSSFYCLEYFPSQMLRTGNNFEFSYNFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHRDDEERFFPSSGVLMFGRQGAGRDNVDYSSVMLTSEEEIRTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFNQARLASFITQYSTGQVSVEIEWELQKENSKRWNPEIQYTSNYYKSTNVDFAVNTEGTYSEPRPIGTRYLTRNL

SEQ ID NO: 1543 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctccaagcgggtgacaatccgtacctgcggtataatcacgccgacgccgagtttcaggagcgtctgcaagaagatacgtcttttgggggcaacctcgggcgcgcagtcttccaggccaaaaagcgggttctcgaacctctgggcctggttgaatcgccggttaagacggctcctggaaagaagagaccggtagagccatcaccccagcgctctccagactcctctacgggcatcggcaagaaaggccagcagcccgcaaaaaagagactcaattttgggcagactggcgactcagagtcagtccccgaccctcaaccaatcggagaaccaccagcagccccctctggtgtgggacctaatacaatggctgcaggcggtggcgctccaatggcagacaataacgaaggcgccgacggagtgggtagttcctcaggaaattggcattgcgattccacatggctgggcgacagagtcatcaccaccagcacccgcacctgggccctgcccacctacaacaaccacctctacaagcaaatctccaacgggacctcgggaggaagcaccaacgacaacacctacttcggctacagcaccccctgggggtattttgacttcaacagattccactgccacttttcaccacgtgactggcagcgactcatcaacaacaactggggattccggcccaagaggctcaacttcaagctcttcaacatccaagtcaaggaggtcacgcagaatgaaggcaccaagaccatcgccaataaccttaccagcacgattcaggtctttacggactcggaataccagctcccgtacgtgctcggctcggcgcaccagggctgcctgcctccgttcccggcggacgtcttcatgattcctcagtacgggtacctgactctgaacaatggcagtcaggctgtgggccggtcgtccttctactgcctggagtactttccttctcaaatgctgagaacgggcaacaactttgaattcagctacaacttcgaggacgtgcccttccacagcagctacgcgcacagccagagcctggaccggctgatgaaccctctcatcgaccagtacttgtactacctgtcccggactcaaagcacgggcggtactgcaggaactcagcagttgctattttctcaggccgggcctaacaacatgtcggctcaggccaagaactggctacccggtccctgctaccggcagcaacgcgtctccacgacactgtcgcagaacaacaacagcaactttgcctggacgggtgccaccaagtatcatctgaatggcagagactctctggtgaatcctggcgttgccatggctacccacaaggacgacgaagagcgattttttccatccagcggagtcttaatgtttgggaaacagggagctggaaaagacaacgtggactatagcagcgtgatgctaaccagcgaggaagaaataaagaccaccaacccagtggccacagaacagtacggcgtggtggccgataacctgcaacagcaaaacgccgctcctattgtaggggccgtcaatagtcaaggagccttacctggcatggtgtggcagaaccgggacgtgtacctgcagggtcccatctgggccaagattcctcatacggacggcaactttcatccctcgccgctgatgggaggctttggactgaagcatccgcctcctcagatcctgattaaaaacacacctgttcccgcggatcctccgaccaccttcaatcaggccaagctggcttctttcatcacgcagtacagtaccggccaggtcagcgtggagatcgagtgggagctgcagaaggagaacagcaaacgctggaacccagagattcagtacacttccaactactacaaatctacaaatgtggactttgctgtcaatactgagggtacttattccgagcctcgccccattggcacccgttacctcacccgtaatctg

SEQ ID NO: 1544 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacctgaaacctggagccccgaaacccaaagccaaccagcaaaggcaggacaacggccggggtctggtgcttcctggctacaggtacctcggacccttcaacggactcgacaagggggagcccgtcaacgcggcggacgcagcggccctcgagcacgacagggcctacgaccagcagctccaagcgggtgacaatccgtacctgcggtataatcacgccgacgccgagtttcaggagcgtctgcaagaagatacgtcttttgggggcaacctcgggcgcgcagtcttccaggccaaaaagcgggttctcgaacctctgggcctggttgaatcgccggttaggacggctcctggaaagaagagaccggtagagccatcaccccagcgctctccagactcctctacgggcatcggcaagaaaggccagcagcccgcaagaaagagactcaattttgggcagactggcgactcagagtcagtccccgaccctcaaccaatcggagaaccaccagcagccccctctggtgtgggacctaatacaatggctgcaggcggtggcgctccaatggcagacaataacgaaggcgccgacggagtgggtagttcctcaggaaattggcattgcgattccacatggctgggcgacagagtcatcaccaccagcacccgcacctgggccctgcccacctacaacaaccacctctacaggcaaatctccaacgggacctcgggaggaagcaccaacgacaacacctacttcggctacagcaccccctgggggtattttgacttcaacagattccactgccacttttcaccacgtgactggcagcgactcatcaacaacaactggggattccggcccaagaggctcaacttcaagctcttcaacatccaagtcaaggaggtcacgcagaatgaaggcaccaggaccatcgccaataaccttaccagcacgattcaggtctttacggactcggaataccagctcccgtacgtgctcggctcggcgcaccagggctgcctgcctccgttcccggcggacgtcttcatgattcctcagtacgggtacctgactctgaacaatggcagtcaggctgtgggccggtcgtccttctactgcctggagtactttccttctcaaatgctgagaacgggcaacaactttgaattcagctacaacttcgaggacgtgcccttccacagcagctacgcgcacagccagagcctggaccggctgatgaaccctctcatcgaccagtacttgtactacctgtcccggactcaaagcacgggcggtactgcaggaactcagcagttgctattttctcaggccgggcctaacaacatgtcggctcaggccaagaactggctacccggtccctgctaccggcagcaacgcgtctccacgacactgtcgcagaacaacaacagcaactttgcctggacgggtgccaccaagtatcatctgaatggcagagactctctggtgaatcctggcgttgccatggctacccacagggacgacgaagagcgattttttccatccagcggagtcttaatgtttgggagacagggagctggaagagacaacgtggactatagcagcgtgatgctaaccagcgaggaagaaataaggaccaccaacccagtggccacagaacagtacggcgtggtggccgataacctgcaacagcaaaacgccgctcctattgtaggggccgtcaatagtcaaggagccttacctggcatggtgtggcagaaccgggacgtgtacctgcagggtcccatctgggccaagattcctcatacggacggcaactttcatccctcgccgctgatgggaggctttggactgaagcatccgcctcctcagatcctgattaaaaacacacctgttcccgcggatcctccgaccaccttcaatcaggccaagctggcttctttcatcacgcagtacagtaccggccaggtcagcgtggagatcgagtgggagctgcagaaggagaacagcaaacgctggaacccagagattcagtacacttccaactactacaaatctacaaatgtggactttgctgtcaatactgagggtacttattccgagcctcgccccattggcacccgttacctcacccgtaatctgtaa

SEQ ID NO: 1545 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacctgaaacctggagccccgaaacccaaagccaaccagcaaaggcaggacaacggccggggtctggtgcttcctggctacaggtacctcggacccttcaacggactcgacaagggggagcccgtcaacgcggcggacgcagcggccctcgagcacgacagggcctacgaccagcagctccaagcgggtgacaatccgtacctgcggtataatcacgccgacgccgagtttcaggagcgtctgcaagaagatacgtcttttgggggcaacctcgggcgcgcagtcttccaggccaaaaagcgggttctcgaacctctgggcctggttgaatcgccggttaggacggctcctggaaagaagagaccggtagagccatcaccccagcgctctccagactcctctacgggcatcggcaagagaggccagcagcccgcaagaaagagactcaattttgggcagactggcgactcagagtcagtccccgaccctcaaccaatcggagaaccaccagcagccccctctggtgtgggacctaatacaatggctgcaggcggtggcgctccaatggcagacaataacgaaggcgccgacggagtgggtagttcctcaggaaattggcattgcgattccacatggctgggcgacagagtcatcaccaccagcacccgcacctgggccctgcccacctacaacaaccacctctacaggcaaatctccaacgggacctcgggaggaagcaccaacgacaacacctacttcggctacagcaccccctgggggtattttgacttcaacagattccactgccacttttcaccacgtgactggcagcgactcatcaacaacaactggggattccggcccaagaggctcaacttcaagctcttcaacatccaagtcaaggaggtcacgcagaatgaaggcaccaggaccatcgccaataaccttaccagcacgattcaggtctttacggactcggaataccagctcccgtacgtgctcggctcggcgcaccagggctgcctgcctccgttcccggcggacgtcttcatgattcctcagtacgggtacctgactctgaacaatggcagtcaggctgtgggccggtcgtccttctactgcctggagtactttccttctcaaatgctgagaacgggcaacaactttgaattcagctacaacttcgaggacgtgcccttccacagcagctacgcgcacagccagagcctggaccggctgatgaaccctctcatcgaccagtacttgtactacctgtcccggactcaaagcacgggcggtactgcaggaactcagcagttgctattttctcaggccgggcctaacaacatgtcggctcaggccaagaactggctacccggtccctgctaccggcagcaacgcgtctccacgacactgtcgcagaacaacaacagcaactttgcctggacgggtgccaccaagtatcatctgaatggcagagactctctggtgaatcctggcgttgccatggctacccacagggacgacgaagagcgattttttccatccagcggagtcttaatgtttgggaaacagggagctggaagagacaacgtggactatagcagcgtgatgctaaccagcgaggaagaaataaggaccaccaacccagtggccacagaacagtacggcgtggtggccgataacctgcaacagcaaaacgccgctcctattgtaggggccgtcaatagtcaaggagccttacctggcatggtgtggcagaaccgggacgtgtacctgcagggtcccatctgggccaagattcctcatacggacggcaactttcatccctcgccgctgatgggaggctttggactgaagcatccgcctcctcagatcctgattaaaaacacacctgttcccgcggatcctccgaccaccttcaatcaggccaagctggcttctttcatcacgcagtacagtaccggccaggtcagcgtggagatcgagtgggagctgcagaaggagaacagcaaacgctggaacccagagattcagtacacttccaactactacaaatctacaaatgtggactttgctgtcaatactgagggtacttattccgagcctcgccccattggcacccgttacctcacccgtaatctgtaa

SEQ ID NO: 1546 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacctgaaacctggagccccgaaacccaaagccaaccagcaaaggcaggacaacggccggggtctggtgcttcctggctacaggtacctcggacccttcaacggactcgacaagggggagcccgtcaacgcggcggacgcagcggccctcgagcacgacagggcctacgaccagcagctccaagcgggtgacaatccgtacctgcggtataatcacgccgacgccgagtttcaggagcgtctgcaagaagatacgtcttttgggggcaacctcgggcgcgcagtcttccaggccaaaaagcgggttctcgaacctctgggcctggttgaatcgccggttaggacggctcctggaaagaagagaccggtagagccatcaccccagcgctctccagactcctctacgggcatcggcaagagaggccagcagcccgcaaaaaagagactcaattttgggcagactggcgactcagagtcagtccccgaccctcaaccaatcggagaaccaccagcagccccctctggtgtgggacctaatacaatggctgcaggcggtggcgctccaatggcagacaataacgaaggcgccgacggagtgggtagttcctcaggaaattggcattgcgattccacatggctgggcgacagagtcatcaccaccagcacccgcacctgggccctgcccacctacaacaaccacctctacaggcaaatctccaacgggacctcgggaggaagcaccaacgacaacacctacttcggctacagcaccccctgggggtattttgacttcaacagattccactgccacttttcaccacgtgactggcagcgactcatcaacaacaactggggattccggcccaagaggctcaacttcaagctcttcaacatccaagtcaaggaggtcacgcagaatgaaggcaccaggaccatcgccaataaccttaccagcacgattcaggtctttacggactcggaataccagctcccgtacgtgctcggctcggcgcaccagggctgcctgcctccgttcccggcggacgtcttcatgattcctcagtacgggtacctgactctgaacaatggcagtcaggctgtgggccggtcgtccttctactgcctggagtactttccttctcaaatgctgagaacgggcaacaactttgaattcagctacaacttcgaggacgtgcccttccacagcagctacgcgcacagccagagcctggaccggctgatgaaccctctcatcgaccagtacttgtactacctgtcccggactcaaagcacgggcggtactgcaggaactcagcagttgctattttctcaggccgggcctaacaacatgtcggctcaggccaagaactggctacccggtccctgctaccggcagcaacgcgtctccacgacactgtcgcagaacaacaacagcaactttgcctggacgggtgccaccaagtatcatctgaatggcagagactctctggtgaatcctggcgttgccatggctacccacagggacgacgaagagcgattttttccatccagcggagtcttaatgtttgggagacagggagctggaagagacaacgtggactatagcagcgtgatgctaaccagcgaggaagaaataaggaccaccaacccagtggccacagaacagtacggcgtggtggccgataacctgcaacagcaaaacgccgctcctattgtaggggccgtcaatagtcaaggagccttacctggcatggtgtggcagaaccgggacgtgtacctgcagggtcccatctgggccaagattcctcatacggacggcaactttcatccctcgccgctgatgggaggctttggactgaagcatccgcctcctcagatcctgattaaaaacacacctgttcccgcggatcctccgaccaccttcaatcaggccaagctggcttctttcatcacgcagtacagtaccggccaggtcagcgtggagatcgagtgggagctgcagaaggagaacagcaaacgctggaacccagagattcagtacacttccaactactacaaatctacaaatgtggactttgctgtcaatactgagggtacttattccgagcctcgccccattggcacccgttacctcacccgtaatctgtaa

SEQ ID NO: 1547 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacctgaaacctggagccccgaaacccaaagccaaccagcaaaggcaggacaacggccggggtctggtgcttcctggctacaggtacctcggacccttcaacggactcgacaagggggagcccgtcaacgcggcggacgcagcggccctcgagcacgacagggcctacgaccagcagctccaagcgggtgacaatccgtacctgcggtataatcacgccgacgccgagtttcaggagcgtctgcaagaagatacgtcttttgggggcaacctcgggcgcgcagtcttccaggccaaaaagcgggttctcgaacctctgggcctggttgaatcgccggttaggacggctcctggaaagaagagaccggtagagccatcaccccagcgctctccagactcctctacgggcatcggcaagagaggccagcagcccgcaaaaaagagactcaattttgggcagactggcgactcagagtcagtccccgaccctcaaccaatcggagaaccaccagcagccccctctggtgtgggacctaatacaatggctgcaggcggtggcgctccaatggcagacaataacgaaggcgccgacggagtgggtagttcctcaggaaattggcattgcgattccacatggctgggcgacagagtcatcaccaccagcacccgcacctgggccctgcccacctacaacaaccacctctacaggcaaatctccaacgggacctcgggaggaagcaccaacgacaacacctacttcggctacagcaccccctgggggtattttgacttcaacagattccactgccacttttcaccacgtgactggcagcgactcatcaacaacaactggggattccggcccaagaggctcaacttcaagctcttcaacatccaagtcaaggaggtcacgcagaatgaaggcaccaggaccatcgccaataaccttaccagcacgattcaggtctttacggactcggaataccagctcccgtacgtgctcggctcggcgcaccagggctgcctgcctccgttcccggcggacgtcttcatgattcctcagtacgggtacctgactctgaacaatggcagtcaggctgtgggccggtcgtccttctactgcctggagtactttccttctcaaatgctgagaacgggcaacaactttgaattcagctacaacttcgaggacgtgcccttccacagcagctacgcgcacagccagagcctggaccggctgatgaaccctctcatcgaccagtacttgtactacctgtcccggactcaaagcacgggcggtactgcaggaactcagcagttgctattttctcaggccgggcctaacaacatgtcggctcaggccaagaactggctacccggtccctgctaccggcagcaacgcgtctccacgacactgtcgcagaacaacaacagcaactttgcctggacgggtgccaccaagtatcatctgaatggcagagactctctggtgaatcctggcgttgccatggctacccacagggacgacgaagagcgattttttccatccagcggagtcttaatgtttgggaaacagggagctggaagagacaacgtggactatagcagcgtgatgctaaccagcgaggaagaaataaggaccaccaacccagtggccacagaacagtacggcgtggtggccgataacctgcaacagcaaaacgccgctcctattgtaggggccgtcaatagtcaaggagccttacctggcatggtgtggcagaaccgggacgtgtacctgcagggtcccatctgggccaagattcctcatacggacggcaactttcatccctcgccgctgatgggaggctttggactgaagcatccgcctcctcagatcctgattaaaaacacacctgttcccgcggatcctccgaccaccttcaatcaggccaggctggcttctttcatcacgcagtacagtaccggccaggtcagcgtggagatcgagtgggagctgcagaaggagaacagcaaacgctggaacccagagattcagtacacttccaactactacaaatctacaaatgtggactttgctgtcaatactgagggtacttattccgagcctcgccccattggcacccgttacctcacccgtaatctgtaa

SEQ ID NO: 1548 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacctgaaacctggagccccgaaacccaaagccaaccagcaaaggcaggacaacggccggggtctggtgcttcctggctacaggtacctcggacccttcaacggactcgacaagggggagcccgtcaacgcggcggacgcagcggccctcgagcacgacagggcctacgaccagcagctccaagcgggtgacaatccgtacctgcggtataatcacgccgacgccgagtttcaggagcgtctgcaagaagatacgtcttttgggggcaacctcgggcgcgcagtcttccaggccaaaaagcgggttctcgaacctctgggcctggttgaatcgccggttaggacggctcctggaaagaagagaccggtagagccatcaccccagcgctctccagactcctctacgggcatcggcaagaaaggccagcagcccgcaaaaaagagactcaattttgggcagactggcgactcagagtcagtccccgaccctcaaccaatcggagaaccaccagcagccccctctggtgtgggacctaatacaatggctgcaggcggtggcgctccaatggcagacaataacgaaggcgccgacggagtgggtagttcctcaggaaattggcattgcgattccacatggctgggcgacagagtcatcaccaccagcacccgcacctgggccctgcccacctacaacaaccacctctacaggcaaatctccaacgggacctcgggaggaagcaccaacgacaacacctacttcggctacagcaccccctgggggtattttgacttcaacagattccactgccacttttcaccacgtgactggcagcgactcatcaacaacaactggggattccggcccaagaggctcaacttcaagctcttcaacatccaagtcaaggaggtcacgcagaatgaaggcaccaggaccatcgccaataaccttaccagcacgattcaggtctttacggactcggaataccagctcccgtacgtgctcggctcggcgcaccagggctgcctgcctccgttcccggcggacgtcttcatgattcctcagtacgggtacctgactctgaacaatggcagtcaggctgtgggccggtcgtccttctactgcctggagtactttccttctcaaatgctgagaacgggcaacaactttgaattcagctacaacttcgaggacgtgcccttccacagcagctacgcgcacagccagagcctggaccggctgatgaaccctctcatcgaccagtacttgtactacctgtcccggactcaaagcacgggcggtactgcaggaactcagcagttgctattttctcaggccgggcctaacaacatgtcggctcaggccaagaactggctacccggtccctgctaccggcagcaacgcgtctccacgacactgtcgcagaacaacaacagcaactttgcctggacgggtgccaccaagtatcatctgaatggcagagactctctggtgaatcctggcgttgccatggctacccacagggacgacgaagagcgattttttccatccagcggagtcttaatgtttgggagacagggagctggaagagacaacgtggactatagcagcgtgatgctaaccagcgaggaagaaataaggaccaccaacccagtggccacagaacagtacggcgtggtggccgataacctgcaacagcaaaacgccgctcctattgtaggggccgtcaatagtcaaggagccttacctggcatggtgtggcagaaccgggacgtgtacctgcagggtcccatctgggccaagattcctcatacggacggcaactttcatccctcgccgctgatgggaggctttggactgaagcatccgcctcctcagatcctgattaaaaacacacctgttcccgcggatcctccgaccaccttcaatcaggccaggctggcttctttcatcacgcagtacagtaccggccaggtcagcgtggagatcgagtgggagctgcagaaggagaacagcaaacgctggaacccagagattcagtacacttccaactactacaaatctacaaatgtggactttgctgtcaatactgagggtacttattccgagcctcgccccattggcacccgttacctcacccgtaatctgtaa

SEQ ID NO: 1549 - protein, 744 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGQRGESGHGYFAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 1550 - DNA, 8359 bp, Artificial Sequence
  Description of Artificial Sequence: Synthetic polynucleotide
catcatcaataatataccttattttggattgaagccaatatgataatgagggggtggagtttgtgacgtggcgcggggcgtgggaacggggcgggtgacgtagtagctctagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggcaccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggccagagaggcgagtctggtcatggttattttgcccaggcggccaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatgctctagaggtcctgtattagaggtcacgtgagtgttttgcgacattttgcgacaccatgtggtcacgctgggtatttaagcccgagtgagcacgcagggtctccattttgaagcgggaggtttgaacgcgcagccaccacggcggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcatcgctggcgtaatagcgaagaggcccgcaccgatcgcccttcccaacagttgcgcagcctgaatggcgaatggcgattccgttgcaatggctggcggtaatattgttctggatattaccagcaaggccgatagtttgagttcttctactcaggcaagtgatgttattactaatcaaagaagtattgcgacaacggttaatttgcgtgatggacagactcttttactcggtggcctcactgattataaaaacacttctcaggattctggcgtaccgttcctgtctaaaatccctttaatcggcctcctgtttagctcccgctctgattctaacgaggaaagcacgttatacgtgctcgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttaaatatttgcttatacaatcttcctgtttttggggcttttctgattatcaaccggggtacatatgattgacatgctagttttacgattaccgttcatcgattctcttgtttgctccagactctcaggcaatgacctgatagcctttgtagagacctctcaaaaatagctaccctctccggcatgaatttatcagctagaacggttgaatatcatattgatggtgatttgactgtctccggcctttctcacccgtttgaatctttacctacacattactcaggcattgcatttaaaatatatgagggttctaaaaatttttatccttgcgttgaaataaaggcttctcccgcaaaagtattacagggtcataatgtttttggtacaaccgatttagctttatgctctgaggctttattgcttaattttgctaattctttgccttgcctgtatgatttattggatgttggaattcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagaattcc

SEQ ID NO: 1551 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGASTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRTLQFSQAGPSSMANQAKNWLPGPCYRQQRVSKTANQNNNSNFAWTGATKYHLNGRDSLVNPGPAMATHKDDEDKFFPMSGVLIFGKQGAGNSNVDLDNVMITSEEEIKTTNPVATEQYGTVATNLQSSNTAPATGTVNSQGALPGMVWQNRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 1552 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcaatcaccccaggaaccagactcctcttcgggcatcggcaagaaaggccagcagcccgcgaagaagagactcaactttgggcagacaggcgactcagagtcagtgcccgaccctcaaccactcggagaaccccccgcagccccctctggtgtgggatctaatacaatggcagcaggcggtggcgctccaatggcagacaataacgaaggcgccgacggagtgggtaacgcctcaggaaattggcattgcgattccacatggctgggcgacagagtcatcaccaccagcacccgaacctgggccctccccacctacaacaaccacctctacaagcaaatctccagccaatcgggagcaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgacgaatgatggcaccacgaccatcgccaataaccttaccagcacggttcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctacacgtttgaggacgtgccttttcacagcagctacgcgcacagccaaagcctggaccggctgatgaaccccctcatcgaccagtacctgtactacctgtctcggactcagaccacgagtggtaccgcaggaaatcggacgttgcaattttctcaggccgggcctagtagcatggcgaatcaggccaaaaactggctacccgggccctgctaccggcagcaacgcgtctccaagacagcgaatcaaaataacaacagcaactttgcctggaccggtgccaccaagtatcatctgaatggcagagactctctggtaaatcccggtcccgctatggcaacccacaaggacgacgaagacaaattttttccgatgagcggagtcttaatatttgggaaacagggagctggaaatagcaacgtggaccttgacaacgttatgataaccagtgaggaagaaattaaaaccaccaacccagtggccacagaacagtacggcacggtggccactaacctgcaatcgtcaaacaccgctcctgctacagggaccgtcaacagtcaaggagccttacctggcatggtctggcagaaccgggacgtgtacctgcagggtcctatctgggccaagattcctcacacggacggacactttcatccctcgccgctgatgggaggctttggactgaaacacccgcctcctcagatcctgattaagaatacacctgttcccgcgaatcctccaactaccttcagtccagctaagtttgcgtcgttcatcacgcagtacagcaccggacaggtcagcgtggaaattgaatgggagctgcagaaagaaaacagcaaacgctggaacccagagattcaatacacttccaactacaacaaatctacaaatgtggactttgctgttgacacaaatggcgtttattctgagcctcgccccatcggcacccgttacctcacccgtaatctg

SEQ ID NO: 1553 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSTGIGKKGQQPAKKRLNFGQTGDSESVPDPQPLGEPPAAPSGVGSNTMAAGGGAPMADNNEGADGVGNASGNWHCDSTWLGDRVITTSTRTWALPTYNNHLYKQISNSQSGGSTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTGGTAGNRTLQFSQAGPSSMANQAKNWLPGPCYRQQRVSKTTNQNNNSNFAWTGATKYHLNGRDSLVNPGVAMATHKDDEDRFFPSSGVLIFGKQGAGNDNVDLDNVMITSEEEIKTTNPVATEEYGVVATNLQSANTAPQTGTVNSQGALPGMVWQNRDVYLQGPIWAKIPHTDGNFHPSPLMGGFGLKHPPPQILIKNTPVPANPPTTFSPAKFASFITQYSTGQVSVEIEWELQKENSKRWNPEIQYTSNYNKSTNVDFAVDTEGVYSEPRPIGTRYLTRNL

SEQ ID NO: 1554 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcaatcaccccaggaaccagactcctctacgggcatcggcaagaaaggccagcagcccgcgaaaaagagactcaactttgggcagactggcgactcagagtcagtgcccgaccctcaaccactcggagaaccccccgcagccccctctggtgtgggatctaatacaatggctgcaggcggtggcgctccaatggcagacaataacgaaggcgccgacggagtgggtaatgcctcaggaaattggcattgcgattccacatggctgggcgacagagtcatcaccaccagcacccgaacctgggccctccccacctacaacaaccacctctacaagcaaatctccaacagccaatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgacgaatgatggcaccacgaccatcgccaataaccttaccagcacggttcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctacacgtttgaggacgtgccttttcacagcagctacgcgcacagccaaagcctggaccggctgatgaaccccctcatcgaccagtacctgtactacctgtctcggactcagaccacgggaggtaccgcaggaaatcggacgttgcaattttctcaggccgggcctagtagcatggcgaatcaggccaaaaactggctacccgggccctgctaccggcagcaacgcgtctccaagacaacgaatcaaaataacaacagcaactttgcctggaccggtgccaccaagtatcatctgaatggcagagactctctggtaaatcccggtgtcgctatggcaacccacaaggacgacgaagaccgattttttccgtccagcggagtcttaatatttgggaaacagggagctggaaatgacaacgtggaccttgacaacgttatgataaccagtgaggaagaaattaaaaccaccaacccagtggccacagaagagtacggcgtggtggccactaacctgcaatcggcaaacaccgctcctcaaacagggaccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcgaatcctccaactaccttcagtccagctaagtttgcgtcgttcatcacgcagtacagcaccggacaggtcagcgtggaaattgaatgggagctgcagaaagaaaacagcaaacgctggaacccagagattcaatacacttccaactacaacaaatctacaaatgtggactttgctgttgacacagaaggcgtttattctgagcctcgccccatcggcacccgttacctcacccgtaatctg

SEQ ID NO: 1555 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQREPDSSTGIGKKGQQPAKKRLNFGQTGDSESVPDPQPLGEPPAAPSGVGSNTMAAGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTGGTAGTQTLQFSQAGPSSMANQAKNWLPGPCYRQQRVSTTTNQNNNSNFAWTGATKYHLNGRDSLVNPGVAMATHKDDEDRFFPSSGVLIFGKQGAGNDNVDYSNVMITSEEEIKTTNPVATEEYGVVATNLQSANTAPQTGTVNSQGALPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 1556 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcaccacagcgtgagcccgactcctccacgggcatcggcaagaaaggccagcagcccgccaaaaagagactcaatttcggtcagactggcgactcagagtcagtccccgaccctcaacctctcggagaacctccagcagcgccctctggtgtgggatctaatacaatggctgcaggcggtggcgcaccaatggcagacaataacgaaggtgccgacggagtgggtaattcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcaacttcaagctcttcaacatccaggtcaaagaggtcacgacgaatgaaggcaccaagaccatcgccaataacctcaccagcaccgtccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaactttcaattcagctacactttcgaggacgtgcctttccacagcagctacgcgcacagccagagtttggacaggctgatgaatcctctcatcgaccagtacctgtactacctgtcaagaacccagactacgggaggcacagcgggaacccagacgttgcagttttctcaggccgggcctagcagcatggcgaatcaggccaaaaactggctgcctggaccctgctacagacagcagcgcgtctccacgacaacgaatcaaaacaacaacagcaactttgcctggactggtgccaccaagtatcatctgaacggcagagactctctggtgaatccgggcgtcgccatggcaacccacaaggacgacgaggaccgcttcttcccatccagcggcgtcctcatatttggcaagcagggagctggaaatgacaacgtggactatagcaacgtgatgataaccagcgaggaagaaatcaagaccaccaaccccgtggccacagaagagtatggcgtggtggctactaacctacagtcggcaaacaccgctcctcaaacggggaccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacaacgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctg

SEQ ID NO: 1557 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQREPDSSTGIGKKGQQPARKRLNFGQTGDSESVPDPQPLGEPPAAPSGVGSNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTGGTAGTQTLQFSQAGPSNMANQAKNWLPGPCYRQQRVSTTTSQNNNSNFAWTGATKYHLNGRDSLVNPGVAMATHKDDEDRFFPSSGILIFGKQGAGKDNVDYSNVMLTSEEEIKTTNPVATEEYGVVADNLQQQNTAPQIGTVNSQGALPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 1558 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcaccacagcgtgagcccgactcctccacgggcatcggcaagaaaggccagcagcccgccagaaagagactcaatttcggtcagactggcgactcagagtcagtccccgaccctcaacctctcggagaacctccagcagcgccctctggtgtgggatctaatacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcaacttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaactttcaattcagctacactttcgaggacgtgcctttccacagcagctacgcgcacagccagagtttggacaggctgatgaatcctctcatcgaccagtacctgtactacctgtcaagaacccagactacgggaggcacagcgggaacccagacgttgcagttttctcaggccgggcctagcaacatggcgaatcaggccaaaaactggctgcctggaccctgctacagacagcagcgcgtctccacgacaacgtcgcaaaacaacaacagcaactttgcctggactggtgccaccaagtatcatctgaacggcagagactctctggtgaatccgggcgtcgccatggcaacccacaaggacgacgaggaccgcttcttcccatccagcggcatcctcatatttggcaagcagggagctggaaaagacaacgtggactatagcaacgtgatgctaaccagcgaggaagaaatcaagaccaccaaccccgtggccacagaagagtatggcgtggtggctgataacctacagcagcaaaacaccgctcctcaaatagggaccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacaacgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctg

SEQ ID NO: 1559 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSGVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTAGTQQLLFSQAGPSNMSAQAKNWLPGPCYRQQRVSTTLSQNNNSNFAWTGATKYHLNGRDSLVNPGVAMATHKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 1560 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctggtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcaacttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaactttgagttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccaaaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaacccacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacaacgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctg

SEQ ID NO: 1561 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTAGTQQLLFSQAGPSNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 1562 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctacacgtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctagtaacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacaccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagaaggcacttattctgagcctcgccccatcggcacccgttacctcacccgtaatctg

SEQ ID NO: 1563 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPLGEPPAAPSGVGSGTMAAGGGAPMADNNEGADGVGNASGNWHCDSTWLGDRVITTSTRTWALPTYNNHLYKQISSQSAGSTNDNTYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYTFEDVPFHSSYAHSQSLDRLMNPLIDQYLYYLARTQSTTGGTAGNRELQFYQAGPSTMAEQAKNWLPGPCYRQQRVSKTLDQNNNSNFAWTGATKYHLNGRNSLVNPGVAMATHKDDEDRFFPSSGVLIFGKTGAANKTTLENVLMTNEEEIKTTNPVATEEYGVVSSNLQSANTAPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYDKSTNVDFAVDSEGVYSEPRPIGTRYLTRNL

SEQ ID NO: 1564 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctggaaagaagagaccggtagagccgtcacctcagcgttcccccgactcctccacgggcatcggcaagaaaggccagcagcccgccaaaaagagactcaatttcggtcagactggcgactcagagtcagtccccgaccctcaacctctcggagaacctccagcagcgccctctggtgtgggatctggtacaatggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtcaaagtgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacggttcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacaccttcgaggacgtgcctttccacagcagctacgcacacagccagagcctggaccggctgatgaatcccctcatcgaccagtacttgtactacctggccagaacacagagtaccacaggaggcacagctggcaatcgggaactgcagttttaccaggccgggccttcaactatggccgaacaagccaagaattggttacctggaccttgctaccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcagctaacaaaactacattggaaaatgtgttaatgacaaatgaagaagaaattaaaactactaatcctgtagccacggaagaatacggggtagtcagcagcaacttacaatcggctaatactgcaccccagacacaaactgtcaacagccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactatgataagtcgactaatgtggactttgccgttgacagcgagggtgtttactctgagcctcgccctattggcactcgttacctcacccgtaatctg

SEQ ID NO: 1565 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKSGQQPAKKRLNFGQTGDSESVPDPQPLGEPPAAPSGVGSNTMASGGGAPMADNNEGADGVGNASGNWHCDSTWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTSGTAQNRELQFSQAGPSSMANQAKNWLPGPCYRQQRVSKTANDNNNSNFAWTGATKYHLNGRDSLVNPGPAMASHKDDEDKFFPMSGVLIFGKQGAGASNVDLDNVMITDEEEIKTTNPVATEQYGTVATNLQSSNTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSANVDFTVDTNGVYSEPRPIGTRYLTRNL

SEQ ID NO: 1566 - DNA, 2205 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctcttggtctggttgaggaaggtgctaagacggctcctggaaagaaacgtccggtagagcagtcgccacaagagccagactcctcctcgggcattggcaagtcaggccagcagcccgctaaaaagagactcaattttggtcagactggcgactcagagtcagtccccgacccacaacctctcggagaacctccagcagccccctctggtgtgggatctaatacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtcaatcaggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcaccacgaccatcgctaataaccttaccagcacggttcaagtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgagcagaactcagactacgtccggaactgcccaaaacagggagttgcagtttagccaggcgggtccatctagcatggctaatcaggccaaaaactggctacctggaccctgttaccggcagcagcgcgtttctaaaacagcaaatgacaacaacaacagcaactttgcctggactggtgctacaaaatatcaccttaatgggcgtgattctttagtcaaccctggccctgctatggcctcacacaaagacgacgaagacaagttctttcccatgagcggtgtcttgatttttggaaagcagggcgccggagcttcaaacgttgatttggacaatgtcatgatcacagacgaagaggaaatcaaaaccactaaccccgtggccaccgaacaatatgggactgtggcaaccaatctccagagcagcaacacagcccctgcgaccggaactgtgaattctcagggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccgacaacgttttcgcctgcaaagtttgcttcattcatcacccagtattccacaggacaagtgagcgtggagattgaatgggagctgcagaaagaaaacagcaaacgctggaatcccgaaatacagtatacatctaactataataaatctgccaacgttgatttcactgtggacaccaatggagtttatagtgagcctcgccccattggcacccgttacctcacccgtaacctg

SEQ ID NO: 1567 - protein, 735 aa, Artificial Sequence
  Description of Artificial Sequence: Synthetic polypeptide
MAADGYLPDWLEDNLSEGIREWWDLKPGAPQPKANQQHQDDGRGLVLPGYKYLGPFNGLDKGEPVNEADAAALEHDKAYDQQLKAGDNPYLKYNHADAEFQERLQEDTSFGGNLGRAVFQAKKRVLEPLGLVEEAAKTAPGKKRPVEQSPQEPDSSSGIGKSGQQPARKRLNFGQTGDSESVPDPQPLGEPPAAPSGVGSNTMASGGGAPMADNNEGADGVGNSSGNWHCDSTWLGDRVITTSTRTWALPTYNNHLYKQISSQSGASNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTSGTTQQSRLQFSQAGPSSMAQQAKNWLPGPCYRQQRVSKTANDNNNSNFAWTGATKYHLNGRDSLVNPGPAMASHKDDEEKFFPMHGVLIFGKQGTGASNVDLDNVMITDEEEIRTTNPVATEQYGTVATNLQSSNTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 1568 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggatctgaaacctggagcccctcaacccaaagcgaaccaacaacaccaggacgacggtcggggtcttgtgcttccgggttacaaatacctcggaccctttaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagagggtccttgagcctcttggtctggttgaggaagcagctaaaacggctcctggaaagaagaggcctgtagaacagtctcctcaggaaccggactcatcatctggtattggcaaatcgggccaacagcctgccagaaaaagactaaatttcggtcagactggagactcagagtcagtcccagaccctcaacctctcggagaaccaccagcagccccctcaggtgtgggatctaatacaatggcttcaggcggtggcgcaccaatggcagacaataacgagggtgccgatggagtgggtaattcctcaggaaattggcattgcgattccacatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcaacttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatgatccctcagtatggatacctcaccctgaacaacggaagtcaagcggtgggacgctcatccttttactgcctggagtacttcccttcgcagatgctaaggactggaaataacttcacattcagctataccttcgaggatgtaccttttcacagcagctacgctcacagccagagtttggatcgcttgatgaatcctcttattgatcagtatctgtactacctgagcagaacgcaaacaacctctggaacaacccaacaatcacggctgcaatttagccaggctgggccttcgtctatggctcagcaggccaaaaattggctacctgggccctgctaccggcaacagagagtttcaaagactgctaacgacaacaacaacagtaactttgcttggacaggggccaccaaatatcatctcaatggccgcgactcgctggtgaatccaggaccagctatggccagtcacaaggacgatgaagaaaaatttttccctatgcacggcgttctaatatttggcaaacaagggacaggggcaagtaacgtagatttagataatgtaatgattacggatgaagaagagattcgtaccaccaatcctgtggcaacagagcagtatggaactgtggcaactaacttgcagagctcaaatacagctcccgcgactggaactgtcaatagtcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcttgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttg

SEQ ID NO: 1569 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRTLQFSQAGPSSMANQAKNWLPGPCYRQQRVSKTANQNNNSNFAWTGATKYHLNGRDSLVNPGPAMATHKDDEDKFFPMSGVLIFGKQGAGNSNVDLDNVMITNEEEIKTTNPVATEQYGTVATNLQSANTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 1570 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSGVGSNTMASGGGAPMADNNEGADGVGNASGNWHCDSTWLGDRVITTSTRTWALPTYNNHLYKQISSQSGASTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTSGTAGNRELQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITNEEEIKTTNPVATEEYGTVATNLQSANTAPATGTVNSQGALPGMVWQNRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 1571 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRELQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITSEEEIKTTNPVATEEYGTVATNLQSSNTAPATGTVNSQGALPGMVWQERDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 1572 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSNTMASGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRELQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITSEEEIKTTNPVATEEYGTVATNLQSANTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 1573 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTSGTAGNRTLQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITNEEEIKTTNPVATEEYGTVATNLQSANTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 1574 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRTLQFSQAGPSSMANQAKNWLPGPCYRQQRVSKTANQNNNSNFAWTGATKYHLNGRDSLVNPGPAMATHKDDEDKFFPMSGVLIFGKQGAGNSNVDLDNVMITSEEEIKTTNPVATEQYGTVATNLQSSNTAPATGTVNSQGALPGMVWQNRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 1575 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSGVGSNTMASGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRTLQFSQAGPSSMANQAKNWLPGPCYRQQRVSKTANQNNNSNFAWTGATKYHLNGRDSLVNPGPAMATHKDDEDKFFPMSGVLIFGKQGAGNSNVDLDNVMITSEEEIKTTNPVATEEYGTVATNLQSSNTAPATGTVNSQGALPGMVWQNRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 1576 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSGVGSNTMASGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTSGTAGNRELQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITNEEEIKTTNPVATEQYGTVATNLQSANTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 1577 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcaatcaccccaggaaccagactcctcttcgggcatcggcaagaaaggccagcagcccgcgaaaaagagactcaactttgggcagacaggcgactcagagtcagtgcccgaccctcaaccactcggagaaccccccgcagccccctctggtgtgggatctaatacaatggctgcaggcggtggcgctccaatggcagacaataacgaaggcgccgacggagtgggtaacgcctcaggaaattggcattgcgattccacatggctgggcgacagagtcatcaccaccagcacccgaacctgggccctccccacctacaacaaccacctctacaagcaaatctccagccaatcgggagcaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgacgaatgatggcaccacgaccatcgccaataaccttaccagcacggttcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctacacgtttgaggacgtgccttttcacagcagctacgcgcacagccaaagcctggaccggctgatgaaccccctcatcgaccagtacctgtactacctgtctcggactcagaccacgagtggtaccgcaggaaatcggacgttgcaattttctcaggccgggcctagtagcatggcgaatcaggccaaaaactggctacccgggccctgctaccggcagcaacgcgtctccaagacagcgaatcaaaataacaacagcaactttgcctggaccggtgccaccaagtatcatctgaatggcagagactctctggtaaatcccggtcccgctatggcaacccacaaggacgacgaagacaaattttttccgatgagcggagtcttaatatttgggaaacagggagctggaaatagcaacgtggaccttgacaacgttatgataaccagtgaggaagaaattaaaaccaccaacccagtggccacagaacagtacggcacggtggccactaacctgcaatcgtcaaacaccgctcctgctacagggaccgtcaacagtcaaggagccttacctggcatggtctggcagaaccgggacgtgtacctgcagggtcctatctgggccaagattcctcacacggacggacactttcatccctcgccgctgatgggaggctttggactgaaacacccgcctcctcagatcctgattaagaatacacctgttcccgcgaatcctccaactaccttcagtccagctaagtttgcgtcgttcatcacgcagtacagcaccggacaggtcagcgtggaaattgaatgggagctgcagaaagaaaacagcaaacgctggaacccagagattcaatacacttccaactacaacaaatctacaaatgtggactttgctgttgacacaaatggcgtttattctgagcctcgccccatcggcacccgttacctcacccgtaatctgtaa

SEQ ID NO: 1578 - protein, 738 aa, Artificial Sequence; identical to SEQ ID NO: 7
  Description of Artificial Sequence: Synthetic polypeptide

SEQ ID NO: 1579 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccgcgtgactggcagcgactcatcaacaacaattggggattccggcccaagagactcaacttcaagctcttcaacatccaagtcaaggaggtcacgacgagtgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacaggcaacaacaacagcaattttacctggactggtgcttcaaaatataacctcaatgggcatgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacacaccctgcgaccggagatgtgcatgttatgggagcattacctggcatggtgtggcaagatagagacgtgtacctgcagggtcccatctgggccaaaattcctcacacagatggacactttcacccgtctcctcttatgggcggctttggactcaagcacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttaccgtggacaacaatggactttatactgagcctcgccccattggcacccgttaccttacccgtcccctgtaa

SEQ ID NO: 1580 - DNA, 2211 bp, Artificial Sequence; identical to SEQ ID NO: 1579
  Description of Artificial Sequence: Synthetic polynucleotide

SEQ ID NO: 1581 - DNA, 2202 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggacttgacaagggggaacccgtcaacgcagcggacgcggcagccctcgaacacgacaaggcctacgaccagcagctcaaggccggtgacaacccctacctcaagtacaaccacgccgacgccgagtttcaggagcgtcttcaagaagatacgtcttttgggggcaacctcggacgagcagtcttccaggccaaaaagaggatccttgagcctctgggtctggttgaggaagcggctaagacggctcctggaaaaaagagacctgtagagcaatctccagcagaaccggactcctcttcgggcatcggcaaatcaggccagcagcccgctagaaaaagactgaattttggtcagactggcgacacagagtcagtcccagaccctcaaccactcggacaacctcccgcagccccctctggtgtgggatctactacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccctgcccacctacaacaatcacctctacaagcaaatctccagccaatcaggagccaccaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactccgagtaccagctcccgtacgtcctcggctcggcgcatcagggatgcctcccgccgttcccagcagacgtcttcatggtcccacagtatggatacctcaccctgaacaacgggagtcaggcggtaggacgctcttccttttactgcctggagtactttccttctcagatgctgcgtactggaaacaactttcagtttagctacacttttgaagacgtgcctttccacagcagctacgctcacagccaaagtctggaccgtctcatgaatcctctgatcgaccagtacctgtactatctgaacaggacacaaacagccagtggaactcagcagtctcggctactgtttagccaagctggacccaccagtatgtctcttcaagctaaaaactggctgcctggaccttgctacagacagcagcgtctgtcaaagcaggcaaacgacaacaacaacagcaactttccctggactggtgccaccaaatatcatctgaatggccgggactcattggtgaacccgggccctgctatggccagtcacaaggatgacaaagaaaagtttttccccatgcatggaaccctgatatttggtaaagaaggaacaaatgccaacaacgcggatttggaaaatgtcatgattacagatgaagaagaaatccgcaccaccaatcccgtggctacggagcagtacgggactgtgtcaaataatttgcaaaactcaaacgctggtccaactactggaactgtcaatcaccaaggagcgttacctggtatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaactttagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 1582 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagcattacctggcatggtgtggcaagatagagacgtgtacctgcagggtcccatctgggccaaaattcctcacacagatggacactttcacccgtctcctcttatgggcggctttggactcaagcacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttaccgtggacaacaatggactttatactgagcctcgccccattggcacccgttaccttacccgtcccctgtaa

SEQ ID NO: 1583 - DNA, 2211 bp, Artificial Sequence
  Description of Artificial Sequence: Synthetic polynucleotide
atggctgccgatggttatcttccagattggctcgaggacaacctctctgagggcattcgcaagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggagagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagcattacctggcatggtgtggcaagatagagacgtgtacctgcagggtcccatttgggccaaaattcctcacacagatggacactttcacccgtctcctcttatgggcggctttggactcaagcacccgcctcctcagatcctcatcaaaaacacacctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttaccgtggacaacaatggactttatactgagcctcgccccattggcacccgttaccttacccgtcccctgtaa

SEQ ID NO: 1584 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacacaccctgcgaccggagatgtgcatgttatgggagcattacctggcatggtgtggcaagatagagacgtgtacctgcagggtcccatctgggccaaaattcctcacacagatggacactttcacccgtctcctcttatgggcggctttggactcaagcacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttaccgtggacaacaatggactttatactgagcctcgccccattggcacccgttaccttacccgtcccctgtaa

SEQ ID NO: 1585 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaaaaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttattgcctggaatatttcccatcgcagatgctgagaacgggcaataactttaccttcagctacacctttgaggacgtgcctttccacagcagctacgcgcacagccagagcctggaccggctgatgaatcctctcatcgaccagtacctgtattacctgaacagaactcagaaccagtccggaagtgcccaaaacaaggacttgctgtttagccgggggtctccagctggcatgtctgttcagctcaaaaactggctacctggaccctgttatcggcagcagcgcgtttctaaaacaaaaacagacaacaacaacagcaattttacctggactggtgcttcaaaatataaccttaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagcattacctggcatggtgtggcaagatagagacgtgtacctgcagggtcccatttgggccaaaattcctcacacagatggacactttcacccgtctcctcttatgggcggctttggactcaaacacccgcctcctcagatcctcatcaaaaacacacctgttcctgcgaatcctccggcggagttttcagctacaaagtttgcttcattcatcacccaatactccacaggacaagtgagcgtggaaattgaatgggagctgcagaaagaaaacagcaagcgctggaatcccgaagtgcagtacacatccaattatgcaaaatctgccaacgttgattttaccgtggacaacaatggactttatactgagcctcgccccattggcacccgttaccttacccgtcccctgtaa

SEQ ID NO: 1586 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggtgctaagacggctcctggaaagaagagaccggtagagcagtcgccccaagaaccagactcctcatcgggcatcggcaaatcaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcattaccaccagcacccgaacctgggccctgcccacctataacaaccacctctacaaacaaatctccagcgcttcaacgggggccagcaacgacaaccactacttcggctacagcaccccctgggggtattttgattttaacagattccactgccacttctcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacactcaacaatggcagccaggccgtgggacgttcatccttttactgcctggaatatttcccatcgcagatgctgagaacgggcaataactttaccttcagctacacattcgaggacgtgcctttccacagcagctacgcgcacagccaaagcctggaccggctgatgaatcctctcatcgaccagtacttgtattacctaaacagaactcaaaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcttcacacaaagacgacgaagacaagttctttccaatgagcggtgtcatgatttttggcaaggagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagcattacctggcatggtgtggcaagatagagacgtgtacctgcagggtccaatttgggccaaaattcctcacacagatggacactttcacccgtctcctcttatgggcggctttggacttaagcacccgcctcctcagatcctcatcaaaaacacgcctgttcctgcgaatcctccggcagagttttcggctacaaagtttgcttcattcatcacccagtattccacaggacaagtgagtgtggaaattgaatgggagttgcagaaagaaaacagcaagcgttggaatcccgaagtgcagtacacatctaattatgcaaaatctgccaacgttgatttcactgtggacaacaatggactttatactgagcctcgccccattggcacccgttacctcacccgtcccctgtaa

SEQ ID NO: 1587 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcaccccaagaaccagactcctcctcgggcattggcaaatcaggccagcagcccgctaaaaagagactcaattttggtcagactggcgactcagagtcagtccccgacccacaacctctcggagaacctccagcaacccccgctgctttgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcccaagagactcaacttcaagctcttcaacatccaagtcaaggaggtcacgacgaacgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctgacgctcaacaatggcagcaaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagcattacctggcatggtgtggcaagatagagacgtgtacctgcagggtcccatttgggccaaaattcctcacacggatggacactttcacccgtctcctcttatgggcggctttggactcaagcacccgcctcctcagatcctcatcaaaaacacacctgttcctgcgaatcctccggcagagttttcggctacaaagtttgcttcattcatcacccagtactccacaggacaagtgagcgtggaaattgaatgggagttgcagaaagaaaacagtaagcgctggaatcccgaagtgcagtacacatctaattatgcaaaatctgccaacgttgacttcactgtggacaacaatggactttatactgagcctcgccccattggcacccgttacctcacccgtcccctgtaa

SEQ ID NO: 1588 - DNA, 2970 bp, Artificial Sequence
  Description of Artificial Sequence: Synthetic polynucleotide
agatgaccgccaaggtcgtagagtccgccaaggccattctgggcggcagcaaggtgcgcgtggaccaaaaatgcaaggcctctgcgcagatcgaccccacccccgtgatcgtcacctccaacaccaacatgtgcgccgtgattgacgggaacagcaccaccttcgagcaccagcagcccctgcaggaccggatgttcaagtttgaactcacccgccgcctcgactacgactttggcaaggtcaccaagcaggaagtcaaggactttttccggtgggcggctgatcacgtgactgacgtggctcatgagttttacgtcacaaagggtggagctaagaaaaggcccgccccctctgacgaggatataagcgagcccaagcggccgcgcgtgtcatttgcgcagccggagacgtcagacgcggaagctcccggagacttcgccgacaggtaccaaaacaaatgttctcgtcacgcgggtatgctgcagatgctctttccctgcaagacgtgcgagagaatgaatcagaattccaacgtctgcttcacgcacggtcagaaagattgcggggagtgctttcccgggtcagaatctcaaccggtttctgtcgtcagaaaaacgtatcagaaactgtgcatccttcatcagctccggggggcacccgagatcgcctgctctgcttgcgaccaactcaaccccgatttggacgattgccaatttgagcaataaatgactgaaatcaggtatggctgctgacggttatcttccagattggctcgaggacaacctctctgaaggcattcgcgagtggtgggcgctgaaacctggagctccacaacccaaggccaaccaacagcatcaggacaacggcaggggtcttgtgcttcctgggtacaagtacctcggacccttcaacggactcgacaagggagagccggtcaacgaggcagacgccgcggccctcgagcacgacaaggcctacgacaagcagctcgagcagggggacaacccgtatctcaagtacaaccacggcgacgccgagttccagcagcgcttggcgaccgacacctcttttgggggcaacctcgggcgagcagtcttccaggccaaaaagaggattctcgagcctctgggtctggttgaagagggcgttaaaacggctcctggaaagaaacgcccattagaaaagactccaaatcggccgaccaacccggactctgggaaggccccggccaagaaaaagcaaaaagacggcgaaccagccgactctgctagaaggacactcgactttgaagactctggagcaggagacggaccccctgagggatcatcttccggagaaatgtctcatgatgctgagatgcgtgcggcgccaggcggaaatgctgtcgaggcgggacaaggtgccgatggagtgggtaatgcctccggtgattggcattgcgattccacctggtcagagggccgagtcaccaccaccagcacccgaacctgggtcctacccacgtacaacaaccacctgtacctgcgaatcggaacaacggccaacagcaacacctacaacggattctccaccccctggggatactttgactttaaccgcttccactgccacttttccccacgcgactggcagcgactcatcaacaacaactggggactcaggccgaaatcgatgcgtgttaaaatcttcaacatacaggtcaaggaggtcacgacgtcaaacggcgagactacggtcgctaataaccttaccagcacggttcagatctttgcggattcgacgtatgaactcccatacgtgatggacgccggtcaggaggggagctttcctccgtttcccaacgacgtctttatggttccccaatacggatactgcggagttgtcactggaaaaaaccagaaccagacagacagaaatgccttttactgcctggaatactttccatcccaaatgctaagaactggcaacaattttgaagtcagttaccaatttgaaaaagttcctttccattcaatgtacgcgcacagccagagcctggacagaatgatgaatcctttactggatcagtacctgtggcatctgcaatcgaccactaccggaaattcccttaatcaaggaacagctaccaccacgtacgggaaaattaccactggagactttgcctactacaggaaaaactggttgcctggagcctgcattaaacaacaaaaattttcaaagaatgccaatcaaaactacaagattcccgccagcgggggagacgcccttttaaagtatgacacgcataccactctaaatgggcgatggagtaacatggctcctggacctccaatggcaaccgcaggtgccggggactcggattttagcaacagccagctgatctttgccggacccaatccgagcggtaacacgaccacatcttcaaacaatttgttgtttacctcagaagaggagattgccacaacaaacccacgagacacggacatgtttggacagattgcagataataatcaaaatgccaccaccgcccctcacatcgctaacctggacgctatgggaattgttcccggaatggtctggcaaaacagagacatctactaccagggccctatttgggccaaggtccctcacacggacggacactttcacccttcgccgctgatgggaggatttggactgaaacacccgcctccacagattttcatcaaaaacacccccgtacccgccaatcccaatactacctttagcgctgcaaggattaattcttttctgacgcagtacagcaccggacaagttgccgttcagatcgactgggaaattcagaaggagcattccaaacgctggaatcccgaagttcaatttacttcaaactacggcactcaaaattctatgctgtgggctcccgacaatgctggcaactaccacgaactccgggctattgggtcccgtttcctcacccaccacttgtaa

SEQ ID NO: 1589 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTSDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTGNNNSNFTWTGASKYNLNGHESIINPGTAMASHKDDEDKFFPMSGVMIFGKESAGASNTALDNVMITDEEEIKATNPVATERFGTVAVNFQSSSTHPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1590 - protein, 736 aa, Artificial Sequence; identical to SEQ ID NO: 1589
  Description of Artificial Sequence: Synthetic polypeptide

SEQ ID NO: 1591 - protein, 733 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQERLQEDTSFGGNLGRAVFQAKKRILEPLGLVEEAAKTAPGKKRPVEQSPAEPDSSSGIGKSGQQPARKRLNFGQTGDTESVPDPQPLGQPPAAPSGVGSTTMASGGGAPMADNNEGADGVGNSSGNWHCDSQWLGDRVITTSTRTWALPTYNNHLYKQISSQSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYHLNGRDSLVNPGPAMASHKDDKEKFFPMHGTLIFGKEGTNANNADLENVMITDEEEIRTTNPVATEQYGTVSNNLQNSNAGPTTGTVNHQGALPGMVWQDRDVYLQGPIWAKIPHTDGHFHPSPLMGGFGLKHPPPQIMIKNTPVPANPPTNFSAAKFASFITQYSTGQVSVEIEWELQKENSKRWNPEIQYTSNYNKSVNVDFTVDTNGVYSEPRPIGTRYLTRNL

SEQ ID NO: 1592 - protein, 736 aa, Artificial Sequence; identical to SEQ ID NO: 757
  Description of Artificial Sequence: Synthetic polypeptide

SEQ ID NO: 1593 - protein, 736 aa, Artificial Sequence
  Description of Artificial Sequence: Synthetic polypeptide
MAADGYLPDWLEDNLSEGIRKWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1594 - protein, 736 aa, Artificial Sequence
  Description of Artificial Sequence: Synthetic polypeptide
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTHPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1595 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQLKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1596 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKSGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKGSAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1597 - protein, 736 aa, Artificial Sequence; identical to SEQ ID NO: 688
  Description of Artificial Sequence: Synthetic polypeptide

SEQ ID NO: 1598 - protein, 742 aa, Artificial Sequence
  Description of Artificial Sequence: Synthetic polypeptide
MAADGYLPDWLEDNLSEGIREWWALKPGAPQPKANQQHQDNGRGLVLPGYKYLGPFNGLDKGEPVNEADAAALEHDKAYDKQLEQGDNPYLKYNHADAEFQQRLATDTSFGGNLGRAVFQAKKRILEPLGLVEEGVKTAPGKKRPLEKTPNRPTNPDSGKAPAKKKQKDGEPADSARRTLDFEDSGAGDGPPEGSSSGEMSHDAEMRAAPGGNAVEAGQGADGVGNASGDWHCDSTWSEGRVTTTSTRTWVLPTYNNHLYLRIGTTANSNTYNGFSTPWGYFDFNRFHCHFSPRDWQRLINNNWGLRPKSMRVKIFNIQVKEVTTSNGETTVANNLTSTVQIFADSTYELPYVMDAGQEGSFPPFPNDVFMVPQYGYCGVVTGKNQNQTDRNAFYCLEYFPSQMLRTGNNFEVSYQFEKVPFHSMYAHSQSLDRMMNPLLDQYLWHLQSTTTGNSLNQGTATTTYGKITTGDFAYYRKNWLPGACIKQQKFSKNANQNYKIPASGGDALLKYDTHTTLNGRWSNMAPGPPMATAGAGDSDFSNSQLIFAGPNPSGNTTTSSNNLLFTSEEEIATTNPRDTDMFGQIADNNQNATTAPHIANLDAMGIVPGMVWQNRDIYYQGPIWAKVPHTDGHFHPSPLMGGFGLKHPPPQIFIKNTPVPANPNTTFSAARINSFLTQYSTGQVAVQIDWEIQKEHSKRWNPEVQFTSNYGTQNSMLWAPDNAGNYHELRAIGSRFLTHHL

SEQ ID NO: 1599 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaaggcggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaa

SEQ ID NO: 1600 - DNA, 2592 bp, Artificial Sequence
  Description of Artificial Sequence: Synthetic polynucleotide
ctggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagatggaagtgcagctccaagccagtggtggcggactggtgcaggcaggaggcagcttgaggctcagctgtgccgccagcggcttcaagatcacccactacaccatgggctggttccggcaggcccctggcaaggagagggagttcgtgagcaggattacctggggtggtgacaacaccttctacagcaacagcgtgaagggcaggttcaccatcagcagggacaacgccaagaacaccgtgtacctgcagatgaacagcctgaagcccgaggacaccgccgactactactgtgcagccggcagtaccagcaccgctacccccctgagggtggactactggggcaaaggcactcaggtgacagtgtcttcaggagggggtggcagcgctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaa

SEQ ID NO: 1601 - DNA, 2601 bp, Artificial Sequence
  Description of Artificial Sequence: Synthetic polynucleotide
ctggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagatggaggtgcagctgcaggcttctggaggaggactggtgcaggctggagggagtctgaggctgtcttgcagtgcctcagtgaggactttctccatctacgccatgggctggtttaggcaggctcccgggaaggagcgcgaattcgtggccggaatcaaccggtctggcgacgtgaccaagtacgctgatttcgtgaaaggccggtttagcatttccagagacaacgccaagaatatggtgtatctgcagatgaactccctgaaacctgaagacacagctctgtactattgtgccgctacttgggcctacgataccgtgggggctctgacatcaggatataatttttggggccaggggacccaggtgacagtgagctccggaggaggaggaagcgctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaa

SEQ ID NO: 1602 - DNA, 2367 bp, Artificial Sequence
  Description of Artificial Sequence: Synthetic polynucleotide
ctggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagatgccaagcagtgtaatcgatgcgctgcagtacaagctggagggcaccacgaggctgaccaggaagaggggtctgaagctggccacggccctcagccttagcaataagttcgtagagggcagccccagcggcggcggcggcagcggcggcggcggcagcgctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaa

SEQ ID NO: 1603 - DNA, 2328 bp, Artificial Sequence
  Description of Artificial Sequence: Synthetic polynucleotide
ctggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagatgtataccatctggatgcccgagaaccccaggcccggtaccccctgcgacatcttcaccaacagcaggggcaagcgagccagcaacggcggcggcggcggcagcggcggcggcggcagcgctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaa

SEQ ID NO: 1604 - DNA, 2298 bp, Artificial Sequence
  Description of Artificial Sequence: Synthetic polynucleotide
ctggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagatgaccttcttctacggcggcagcaggggcaagaggaacaacttcaagaccgaggagtacggcggcggcggcagcggcggcggcggcagcgctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaa

SEQ ID NO: 1605 - DNA, 2211 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaaggcggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcaactacgagtttgagaacgtacctttccatagcagctacgctcacagccaaagcctggaccgactaatgaatccactcatcgaccaatacttgtactatctctcaaagactattaacgattctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacgaagtcatgataaccaacgaagaagaaattaaaactactaacccggtagcaacggagtcctatggacaagtggccataaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 1606 - DNA, 2277 bp, Artificial Sequence
  Description of Artificial Sequence: Synthetic polynucleotide
ctggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagatgaacaaccagaagatcgtgaacctgaaggagaaggtggcccagctggaggccggcggcggcggcagcgctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcaactacgagtttgagaacgtacctttccatagcagctacgctcacagccaaagcctggaccgactaatgaatccactcatcgaccaatacttgtactatctctcaaagactattaacgattctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacgaagtcatgataaccaacgaagaagaaattaaaactactaacccggtagcaacggagtcctatggacaagtggccataaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 1607 - DNA, 2313 bp, Artificial Sequence
  Description of Artificial Sequence: Synthetic polynucleotide
ctggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagatgtataccatctggatgcccgagaaccccaggcccggtaccccctgcgacatcttcaccaacagcaggggcaagcgagccagcaacggcggcggcggcggcagcgctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcaactacgagtttgagaacgtacctttccatagcagctacgctcacagccaaagcctggaccgactaatgaatccactcatcgaccaatacttgtactatctctcaaagactattaacgattctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacgaagtcatgataaccaacgaagaagaaattaaaactactaacccggtagcaacggagtcctatggacaagtggccataaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 1608 - DNA, 2283 bp, Artificial Sequence
  Description of Artificial Sequence: Synthetic polynucleotide
ctggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagatgaccttcttctacggcggcagcaggggcaagaggaacaacttcaagaccgaggagtacggcggcggcggcagcgctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcaactacgagtttgagaacgtacctttccatagcagctacgctcacagccaaagcctggaccgactaatgaatccactcatcgaccaatacttgtactatctctcaaagactattaacgattctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacgaagtcatgataaccaacgaagaagaaattaaaactactaacccggtagcaacggagtcctatggacaagtggccataaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 1609 - DNA, 2283 bp, Artificial Sequence
  Description of Artificial Sequence: Synthetic polynucleotide
ctggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagatggcagctgcggccgccgcggctgcagcggctgcagccgccgcagctgcggctgcagcgggcggcggcggcagcgctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcaactacgagtttgagaacgtacctttccatagcagctacgctcacagccaaagcctggaccgactaatgaatccactcatcgaccaatacttgtactatctctcaaagactattaacgattctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacgaagtcatgataaccaacgaagaagaaattaaaactactaacccggtagcaacggagtcctatggacaagtggccataaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 1610 - protein, 726 aa, Artificial Sequence
  Description of Artificial Sequence: Synthetic polypeptide
MEVQLQASGGGLVQAGGSLRLSCAASGFKITHYTMGWFRQAPGKEREFVSRITWGGDNTFYSNSVKGRFTISRDNAKNTVYLQMNSLKPEDTADYYCAAGSTSTATPLRVDYWGKGTQVTVSSGGGGSAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 1611 - protein, 729 aa, Artificial Sequence
  Description of Artificial Sequence: Synthetic polypeptide
MEVQLQASGGGLVQAGGSLRLSCSASVRTFSIYAMGWFRQAPGKEREFVAGINRSGDVTKYADFVKGRFSISRDNAKNMVYLQMNSLKPEDTALYYCAATWAYDTVGALTSGYNFWGQGTQVTVSSGGGGSAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 1612 - protein, 651 aa, Artificial Sequence
  Description of Artificial Sequence: Synthetic polypeptide
MPSSVIDALQYKLEGTTRLTRKRGLKLATALSLSNKFVEGSPSGGGGSGGGGSAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 1613 - protein, 638 aa, Artificial Sequence
  Description of Artificial Sequence: Synthetic polypeptide
MYTIWMPENPRPGTPCDIFTNSRGKRASNGGGGGSGGGGSAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 1614 - protein, 628 aa, Artificial Sequence
  Description of Artificial Sequence: Synthetic polypeptide
MTFFYGGSRGKRNNFKTEEYGGGGSGGGGSAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 1615 - protein, 621 aa, Artificial Sequence
  Description of Artificial Sequence: Synthetic polypeptide
MNNQKIVNLKEKVAQLEAGGGGSAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFNYEFENVPFHSSYAHSQSLDRLMNPLIDQYLYYLSKTINDSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADEVMITNEEEIKTTNPVATESYGQVAINHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 1616 - protein, 633 aa, Artificial Sequence
  Description of Artificial Sequence: Synthetic polypeptide
MYTIWMPENPRPGTPCDIFTNSRGKRASNGGGGGSAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFNYEFENVPFHSSYAHSQSLDRLMNPLIDQYLYYLSKTINDSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADEVMITNEEEIKTTNPVATESYGQVAINHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 1617 - protein, 623 aa, Artificial Sequence
  Description of Artificial Sequence: Synthetic polypeptide
MTFFYGGSRGKRNNFKTEEYGGGGSAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFNYEFENVPFHSSYAHSQSLDRLMNPLIDQYLYYLSKTINDSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADEVMITNEEEIKTTNPVATESYGQVAINHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 1618 - protein, 623 aa, Artificial Sequence
  Description of Artificial Sequence: Synthetic polypeptide
MAAAAAAAAAAAAAAAAAAAGGGGSAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFNYEFENVPFHSSYAHSQSLDRLMNPLIDQYLYYLSKTINDSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADEVMITNEEEIKTTNPVATESYGQVAINHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 1619 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgtcgagtttcaggagcgtctgcaagaagatacgtcttttgggggcaacctcgggcgagcagtcttccaggccaagaagagggttctcgaaccttttggtctggttgaggaaggcgctaagacggctcctggaaagaaacgtccggtagagcagtcgccacaagagccagactcctcctcgggcatcggcaagaaaggccaacagcccgccagaaaaagactcaattttggccagactggcgactcagagtcagttccagaccctcaacctctcggagaacctccagcagcgccctctggtgtgggacctaatacaatggctgcaggcggtggcgcaccaatggcagacaataacgagggcgccgacggagtgggtaattcctcgggaaattggcattgcgattccacatggatgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgatttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccatacgtcctcggctccgcgcaccagggctgcctgcctccgttcccggcggacgtcttcatgattccccagtacggctaccttacactgaacaatggaagtcaagccgtaggccgttcctccttctactgcctggaatattttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaagaactcagcagttgctattttctcaggccgggcctaatacaatggccaatcaggcaaagaactggctgccaggaccctgttaccgccaacaacgcgtctcaacgacaaccgggcaaaacaacaatagcaactctgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccatctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctacagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 1620 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggacggcgctaagacggctcctggaaagaagagaccagtagagcagtcaccccaagaaccagactcctcctcgggcatcggcaagaaaggccaacagcccgccagaaaaagactcaattttggccagactggcgactcagagtcagttccagaccctcaacctctcggagaacctccagcaacccccgctgctgtgggacctactacaatggcttcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaggacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaatcgagtgggagctgcagaaagaaaacagcaagcgctggaaccccgagatccagtacacctccaactactacaaatctacaaatgtggactttgctgtcaacacggagggggtttatagcgagcctcgccccattggcacccgttacctcacccgcaacctgtaa

SEQ ID NO: 1621 - DNA, 2211 bp, Artificial Sequence
  Description of Artificial Sequence: Synthetic polynucleotide
  misc_feature (715)..(715): n is a, c, g, or t
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagaggctcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagantcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccaggggaccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctacagaaggaaaacagcaagcgctggaaccccgagatccagtacacctccaattactacaaatctacaagtgtggactttgctgttaatacagaaggcgtgtactctgaaccccgccccattggcacgcgtttcctcacccgtaatctgtaa

SEQ ID NO: 1622 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagaggctcaattttggccagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgtactaggatccgctcaccagggatgtctgcctccgttcccggcggacgtgttcatgattccccagtacggctacctaacactcaacaacggtagtcaggccgtgggacgctcctccttctactgcctggaatattttccatctcagatgctgagaacgggcaataactttaccttcagctacaccttcgaggacgtgcctttccacagcagctatgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctaatgggaggatttggactgaagcacccacctcctcagatcctgatcaagaacacgccggtacctgcggatcctccgaccaccttcaaccagtcaaagctgtactctttcatcacgcaatacagcaccggacaggtcagcgtggaaattgaatgggagctgcagaaggaaaacagcaagcgctggaaccccgagatccaatacacctccaactactacaaatctacaagtgtggactttgctgttaatacagaaggcgtgtactctgaaccccgccccattggcacccgttacctcacccgtaatctgtaa

SEQ ID NO: 1623 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADVEFQERLQEDTSFGGNLGRAVFQAKKRVLEPFGLVEEGAKTAPGKKRPVEQSPQEPDSSSGIGKKGQQPARKRLNFGQTGDSESVPDPQPLGEPPAAPSGVGPNTMAAGGGAPMADNNEGADGVGNSSGNWHCDSTWMGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTARTQQLLFSQAGPNTMANQAKNWLPGPCYRQQRVSTTTGQNNNSNSAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 1624 - protein, 737 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEDGAKTAPGKKRPVEQSPQEPDSSSGIGKKGQQPARKRLNFGQTGDSESVPDPQPLGEPPATPAAVGPTTMASGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTNVDFAVNTEGVYSEPRPIGTRYLTRNL

SEQ ID NO: 1625 - protein, 736 aa, Artificial Sequence
  Description of Artificial Sequence: Synthetic polypeptide
  MOD_RES (239)..(239): Xaa can be any naturally occurring amino acid
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRXITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGTLPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRFLTRNL

SEQ ID NO: 1626 - protein, 737 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLYSFITQYSTGQVSVEIEWELQKENSKRWNPEIQYTSNYYKSTSVDFAVNTEGVYSEPRPIGTRYLTRNL

SEQ ID NO: 1627 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggtggtggcgcaccagtggcagacaataacgaaggcgccgacggagtgggtagttcctcgggaaattggcattgcgattccacatggctgggcgacagagtcatcaccaccagcacccgaacatgggccttgcccacctataacaaccacctctacaagcaaatctccagtgcttcgacgggggccagcaacgacaaccactacttcggctacagcaccccctgggggtattttgatttcaacaggttccactgccatttctcaccacgtgactggcagcgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaacgggcaacaactttacctttagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaa

SEQ ID NO: 1628 - DNA, 2211 bp, Artificial Sequence
  Description of Artificial Sequence: Synthetic polynucleotide
  misc_feature (337)..(337): n is a, c, g, or t
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctggctacaagtacctcggacccttcaacggactcgacaagggggagcccgtcaacgcggcggacgcagcgaccctcgagcacgacaaggcctacgaccagcagctcaaagcgggtgacaatccgtacctgcggtataaccacgccgacgccgagtttcaggagcgtctgcaagaagatacgtcttttgggggcnacctcgggcgagcagtcttccaggccaagaagcgggttctcgaacctctcggtctggttgaggaagctgctaagacggctcctggaaagaagagaccagtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcagactatcagctcccgtacgtgctcgggtcggctcacgagggctgcctcccgccgttcccagcggacgttttcatgattcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtagccacagaagaatatggagcagtggccatcaacaaccaggccgccaatacgcaggcgcagaccggactcgtgcacaaccagggggtgattcccggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 1629 - DNA, 2214 bp, Artificial Sequence
  Description of Artificial Sequence: Synthetic polynucleotide
  misc_feature (335)..(335): n is a, c, g, or t
atgactgacggttaccttccagattggctagaggacaacctctctgaaggcgttcgagagtggtgggcgctgcaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcancctcgggcgagcagtcttccaggccaagaagcgggttctcgaacctctcggtctggttgaggaaggcgctaagacggctcctggaaagaaacgtccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttaaaccaggccaagctgaactctttcatcacgcaatacagcaccggacaggtcagcgtggaaattgaatgggagctgcagaaggaaaacagcaagcgctggaacccagagattcagtacacttcaaactactacaaatctacaaatgtggactttgctgtcaatacagagggaacttatagtgaaccccgccccattggcaccagatttctgactcgtaatctgtaa

SEQ ID NO: 1630 - DNA, 2211 bp, Artificial Sequence
  Description of Artificial Sequence: Synthetic polynucleotide
  misc_feature (338)..(338): n is a, c, g, or t
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggccccttcaacggactcgacaagggggagcccgtcaacgcggcggacgcagcggccctcgagcacgacaaggcctacgaccagcagctcgaagcgggtgacaatccgtacctgcggtataaccacgccgacgccgagtttcaggagcgtctgcaagaagatacgtcttttgggggcancctcgggcgagcagtcttccaggccaagaagcgggttctcgaacctctcggtctggttgaggaaggcgctaagacggctcctggaaagaagagaccagtagagcagtcaccccaagaaccagactcctcctcgggcatcggcaggaaaggccaacagcccgccagaaaaagactcaattttggccagactggcgactcagagtcagttccagaccctcaacctctcggagaacctccagcagcgccctctggtgtgggacctaatacaatggcttcaggcggtggcgctccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaggtcaaggaggtcacgcagaatgaaggcactaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggcaacaacttccagtttacctacaccttcgaggacgtgcctttccacagcagctacgcccacagccagagcttggaccggctgatgaatcctctgattgaccagtacctgtactacttgtctcggactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggttgataacttgcagcaaaccaatacggggcctattgtgggaaatgtcaacagccaaggagccttacctggtatggtctggcagaaccgggacgtgtacctgcagggtcccatctgggccaagattcctcacacggacggcaacttccacccgtctccgctgatgggcggctttggcctgaaacatcctccgcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 1631 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDRQLDSGDNPYLKYNHADAEFQERLKEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPVADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFTFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 1632 - protein, 736 aa, Artificial Sequence
  Description of Artificial Sequence: Synthetic polypeptide
  MOD_RES (113)..(113): Xaa can be any naturally occurring amino acid
MAADGYLPDWLEDTLSEGIRQWWKLKPGPPPPKPAERHKDDSRGLVLPGYKYLGPFNGLDKGEPVNAADAATLEHDKAYDQQLKAGDNPYLRYNHADAEFQERLQEDTSFGGXLGRAVFQAKKRVLEPLGLVEEAAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSDYQLPYVLGSAHEGCLPPFPADVFMIPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1633 - protein, 737 aa, Artificial Sequence
  Description of Artificial Sequence: Synthetic polypeptide
  MOD_RES (112)..(112): Xaa can be any naturally occurring amino acid
MTDGYLPDWLEDNLSEGVREWWALQPGAPKPKANQQKQDDGRGLVLPGYKYLGPFNGLDKGEPVNAADAAALEHDKAYDQQLKAGDNPYLRYNHADAEFQERLQEDTSFGGXLGRAVFQAKKRVLEPLGLVEEGAKTAPGKKRPVEPSPQRSPDSSTGIGKKGQQPARKRLNFGQTGDSESVPDPQPLGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTLNQAKLNSFITQYSTGQVSVEIEWELQKENSKRWNPEIQYTSNYYKSTNVDFAVNTEGTYSEPRPIGTRFLTRNL

SEQ ID NO: 1634 - protein, 736 aa, Artificial Sequence
  Description of Artificial Sequence: Synthetic polypeptide
  MOD_RES (113)..(113): Xaa can be any naturally occurring amino acid
MAADGYLPDWLEDTLSEGIRQWWKLKPGPPPPKPAERHKDDSRGLVLPGYKYLGPFNGLDKGEPVNAADAAALEHDKAYDQQLEAGDNPYLRYNHADAEFQERLQEDTSFGGXLGRAVFQAKKRVLEPLGLVEEGAKTAPGKKRPVEQSPQEPDSSSGIGRKGQQPARKRLNFGQTGDSESVPDPQPLGEPPAAPSGVGPNTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVVDNLQQTNTGPIVGNVNSQGALPGMVWQNRDVYLQGPIWAKIPHTDGNFHPSPLMGGFGLKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 1635 - DNA, 2211 bp, Artificial Sequence
  Description of Artificial Sequence: Synthetic polynucleotide
atggccgccgacggctacctgcccgactggctggaggacaacctgagcgagggcatccgcgagtggtgggccctgaagcccggcgccccccagcccaaggccaaccagcagcaccaggacaacgcccgcggcctggtgctgcccggctacaagtacctgggccccggcaacggcctggacaagggcgagcccgtgaacgccgccgacgccgccgccctggagcacgacaaggcctacgaccagcagctgaaggccggcgacaacccctacctgaagtacaaccacgccgacgccgagttccaggagcgcctgaaggaggacaccagcttcggcggcaacctgggccgcgccgtgttccaggccaagaagcgcctgctggagcccctgggcctggtggaggaggccgccaagaccgcccccggcaagaagcgccccgtggagcagagcccccaggagcccgacagcagcgccggcatcggcaagagcggcgcccagcccgccaagaagcgcctgaacttcggccagaccggcgacaccgagagcgtgcccgacccccagcccatcggcgagccccccgccgcccccagcggcgtgggcagcctgaccatggccagcggcggcggcgcccccgtggccgacaacaacgagggcgccgacggcgtgggcagcagcagcggcaactggcactgcgacagccagtggctgggcgaccgcgtgatcaccaccagcacccgcacctgggccctgcccacctacaacaaccacctgtacaagcagatcagcaacagcaccagcggcggcagcagcaacgacaacgcctacttcggctacagcaccccctggggctacttcgacttcaaccgcttccactgccacttcagcccccgcgactggcagcgcctgatcaacaacaactggggcttccgccccaagcgcctgaacttcaagctgttcaacatccaggtgaaggaggtgaccgacaacaacggcgtgaagaccatcgccaacaacctgaccagcaccgtgcaggtgttcaccgacagcgactaccagctgccctacgtgctgggcagcgcccacgagggctgcctgccccccttccccgccgacgtgttcatgatcccccagtacggctacctgaccctgaacgacggcagccaggccgtgggccgcagcagcttctactgcctggagtacttccccagccagatgctgcgcaccggcaacaacttccagttcagctacgagttcgagaacgtgcccttccacagcagctacgcccacagccagagcctggaccgcctgatgaaccccctgatcgaccagtacctgtactacctgagcaagaccatcaacggcagcggccagaaccagcagaccctgaagttcagcgtggccggccccagcaacatggccgtgcagggccgcaactacatccccggccccagctaccgccagcagcgcgtgagcaccaccgtgacccagaacaacaacagcgagttcgcctggcccggcgccagcagctgggccctgaacggccgcaacagcctgatgaaccccggccccgccatggccagccacaaggagggcgaggaccgcttcttccccctgagcggcagcctgatcttcggcaagcagggcaccggccgcgacaacgtggacgccgacaaggtgatgatcaccaacgaggaggagatcaagaccaccaaccccgtggccaccgagagctacggccaggtggccaccaaccaccagagcgcccaggcccaggcccagaccggctgggtgcagaaccagggcatcctgcccggcatggtgtggcaggaccgcgacgtgtacctgcagggccccatctgggccaagatcccccacaccgacggcaacttccaccccagccccctgatgggcggcttcggcatgaagcacccccccccccagatcctgatcaagaacacccccgtgcccgccgacccccccaccgccttcaacaaggacaagctgaacagcttcatcacccagtacagcaccggccaggtgagcgtggagatcgagtgggagctgcagaaggagaacagcaagcgctggaaccccgagatccagtacaccagcaactactacaagagcaacaacgtggagttcgccgtgaacaccgagggcgtgtacagcgagccccgccccatcggcacccgctacctgacccgcaacctgtaa

SEQ ID NO: 1636 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccagcagctcaaggccggagacaacccgtacctcaagtacaaccacgccgacgccgagttccaggagcggctcaaagaagatacgtcttttgggggcaacctcggacgagcagtcttccaggccaagaagcgggttctcgaacctctcggtctggttgaggaaggcgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgatggagtgggtagttcctcgggaaattggcattgcgattcccaatggctgggggacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccgacccaagagactcaacttcaagctctttaacattcaagtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaagaaaacagcaaacgctggaacccagagattcaatacacttccaactactacaaatctacaagtgtggactttgctgttaatacagaaggcgtgtactctgaaccccaccccattggcacccgttacctcacccgtcccctgtaa

SEQ ID NO: 1637 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacctgggccctgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaagccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1638 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaatacggctcctggaaagaaacgtccggtagagcagtcgccacaagagccagactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcctcacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagtcaaggagccttacctggcatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacaccaccaactactacaaatctacaagtgtggactttgctgttaatacagaaggcgtgtactctgaaccccaccccattggcacccgttacctcacccgtcccctgtaa

SEQ ID NO: 1639 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgaggcggacgcggcagccctcgaacacgacaaagcttacgaccagcagctcaaggccggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaacagattccactgccacttttcaccacgtgactggcaaagactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctccctccgttcccggcggacgtgttcatgattccgcagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1640 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgaggcggacgcggcagccctcgaacacgacaaagcttacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattcccaatggctgggcgacagagtcatcaccaccagcaccagaacctgggccttgcccacctataacaaccacctctacaagcaaatctccagtgcttcaacgggggccagcaacgacaaccactacttcggctacagcaccccctgggggtattttgatttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggttcaagtcttctcggactcggagtaccagttgccgtacgtcctcggctctgcgcaccagggctgcctccctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1641 - DNA, 2244 bp, Artificial Sequence
  Description of Artificial Sequence: Synthetic polynucleotide
  misc_feature (2241)..(2241): n is a, c, g, or t
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcaccagatacctgactcgtaatctgtaattgcttgttaatcaataaaccgtttaattnttt

SEQ ID NO: 1642 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctccaagcgggtgacaatccgtacctgcggtataaccacgccgacgccgagtttcaggagcgtctgcaagaagatacgtcttttgggggcaacctcggacgagcagtcttccaggcgaaaaagagggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaaccgcttccactgccacttctcaccacgtgactggcagcgactcatcaacaacaactggggattccggcccaagagactcagcttcaaactcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattcctcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggacttaagcacccgcctcctcagatcctcatcaaaaacacgcctgttcctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1643 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaagcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcacccatgcaagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggattcggaataccagctcccgtacgtcctcggctctgcgcaccagggctgcctccctccgttcccggcggacgtgttcatgattccgcagtacggctacctaacgctcaacaatggtagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1644 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtagttcctcgggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1645 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaatttgggatcccggcccaagagactcaacttcaagctcttcatcatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 1646 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaggcgggtgacaatccgtacctgcggtataaccacgccgacgccgagtttcaggagcgtctgcaagaagatacgtcttttgggggcaacctcgggcgagcagtcttccaggccaaaaagaggcttcttgaacctcttggtctggttgaggaagcggctaagacggctcctggaaagaaacgtccggtagagcagtcgccacaagagccagactcctcctcgggcattggcaagacaggccagcagcccgctaaaaagagactcaactttgggcagactggcgactcagagtcagtgcccgaccctcaaccaatcggagaacctccagcaacccccgctgctgtgggacctactacaatggcttcaggcggtggcgcaccaatggcggacaataacgaaggcgccgatggagtgggtaattcctcgggaaattggcattgcgattccacatggctgggcgacagagtcatcaccaccagcacccgaacctgggccctgcccacctacaacaatcacctctacaagcaaatctccagtgcttcaacgggggccagcaacgacaaccactacttcggctacagcaccccctgggggtattttgatttcaacagattccactgccacttttcaccacgtgactggcagcgactcatcaacaacaactggggattccggcccaagagactcaacttcaagctcttcaacatccaggtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgatccccaccccattggcacccgttacctcacccgtcccctgtaa

SEQ ID NO: 1647 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaagagcaggacgacggccggggtctggtgcttcctggctacaagtacctcggacccttcaacggactcgacaagggagagcccgtcaacgcggcggatgcagcggccctcgagcacgacaaagcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccagtgcttcaacgggggccagcaacgacaaccactacttcggctacagcaccccctgggggtattttgactttaacagattccactgccacttttcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggattcggaataccagctcccgtacgtcctcggctctgcgcaccagggctgcctccctccgttcccggcggacgtgttcatgattccgcagtacggctacctaacgctcaacaatggtagccaggcagtgggacggtcatcctttttctgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgagacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1648 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcaccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggacaggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagaacagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtagacaacaatggactttatactgtgcctcgccccattggcacccgttacctcacccgtcccctgtaa

SEQ ID NO: 1649 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgcggcggacgcggcggccctcgaacacgacaaggcttacgaccagcagctcaaggcgggtgacaacccctacctgcggtataaccacgccgacgccgagttccaggagcggctgcaagaagatacgtcttttgggggcaacctcgggcgagcagtcttccaggccaaaaagaggcttcttgaacctcttggtctggttgaggaaggcgctaagacggctcctggaaagaagaggcctgtagagcagtctcctcaagaaccggactcctcctcgggtattggcaaaacaggtgagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtagtgcctcaggaaattggcattgcgattccacatggctgggcgacagagtcatcaccaccagcacccgaacctgggccctgcccacctataacaaccatctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataacctcaccagcaccatccaggtgttcacggactcagagtatcagctgccgtacgtgctcgggtcggctcaccagggctgcctccctccgttcccagcggacgtgttcatgattcctcagtacgggtatctgacactcaacaacggcagtcaggcagtgggacggtcatccttctactgcctggaatattttccatcgcagatgctgagaaccggcaacaactttccgttcagttacaccttcgaggacgtgcctttccacagcagctacgcgcacagccagagcctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1650 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagaacagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtagttcctcgggaaattggcattgcgattcccaatggctgggggacagagtcatcaccaccagcacccgaacctgggccctgcccacctacaacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccaggactgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccggacaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1651 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcaccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggtgccgacggagtgggtaatgcctcaggaaattggcattgcgattccacatggctgggcgactgagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacgctcaacaatggcagccaggcagtgggacggtcatccttttactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatactcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1652 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtacttcaacgggggccagtaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctgcctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacttttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccggacaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1653 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccggcagctcgacagcggagacaacccgtacctgcggtataaccacgccgacgcggagtttcaggagcgccttaaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaacagattccactgccacttttcaccacgtgactggcaaagactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctccctccgttcccggcggacgtgttcatgattccgcagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcactggctaatcctggcatcgctatggcaacacacaaagacgacaggagcgtttttttccagtaccgggatcctgattttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1654 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcagccctcgaacacgacaaagcttacgaccagcagctcaaggccggtgacaacccctacctcaagtataaccacgccgacgccgagtttcaggagcgtcttcaaggagatacgtcttttgggggcaacctcggacgagcagtcttccaggccaagaagcgggttctcgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaacctctcggagaacctccagcagcgccctctggtgtgggacctaatacaatggctgcaggcggtggcgcaccaatggcagacaataacgaaggtgccgatggagtgggtagttcctcgggaaattggcattgcgattcccaatggctgggggacagagtcatcaccaccagcacccgaacctgggccctgcccacctacaacaaccacctctacaagcaaatctccagtgcttcaacgggggccagcaacgacaaccactacttcggctacagcaccccttgggggtattttgacttcaacagattccactgccacttttcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctccctccgttcccggcggacgtgttcatgattccgcagtacggctacctaacgctcaacaatggcagccaggcagtgggacggtcatccttttactgcctggaatactttccttcgcagatgctgagaaccggcaacaacttccagtttacttacaccttcgaggacgtgcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtagcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1655 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagagggttctcgaaccttttggtctggttgaggaagcggctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacggctacctaacactcaacaacggtagtcaggccgtgggacgctcctccttctactgcctggaatactttccttcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggacaaaataccatctgaatggaagaaattcattggctaatcctggcatcgctatggcaacacacaaagacgacaaggagcgtttttttcccagtaacgggattctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggacttaagcacccgcctcctcagatcctcatcaaaaacacgcctgttcctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1656 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtagttcctcgggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggatgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1657 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcaccagaacctgggccttgcccacctacaataaccacctctacaagcaaatctccaacagcacatctggaggatcttcaaatgacaacgcctacttcggctacagcaccccctgggggtattttgactttaacagattccactgccacttttcaccacgtgactggcagcgactcatcaacaacaactggggattccgacccaagagactcaacttcaagctcttcaacatccaggtcaaggaggtcacgcagaacgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacgctcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcactcgttacctcacccgtcccctgtaa

SEQ ID NO: 1658 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcagccctcgaacacgacaaagcttacgaccagcagctcaaggccggtgacaacccctacctcaagtataaccacgccgacgccgagtttcaggagcgtcttcaaggagatacgtcttttgggggcaacctcggacgagcagtcttccaggccaagaagcgggttctcgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaacctctcggagaacctccagcagcgccctctggtgtgggacctaatacaatggctgcaggcggtggcgcaccaatggcagacaataacgaaggtgccgatggagtgggtagttcctcgggaaattggcattgcgattcccaatggctgggggacagagtcatcaccaccagcacccgaacctgggccctgcccacctacaacaaccacctctacaagcaaatctccagtgcttcaacgggggccagcaacgacaaccactacttcggctacagcaccccttgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttgacaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggatgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1659 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggcgactcagagtcagtccccgacccacaacctctcggagaacctccagcaacccccgctgctgtgggacctaatacgatggctacaggcagtggcgcaccaatggcagacaataacgagggcgccgacggagtgggtaattcctcgggaaattggcattgcgattccacatggatgggcgacagagtcatcaccaccagcaccagaacctgggccctgcccacttacaacaaccatctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcaccatccaggtctttacggactcggaataccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcaaggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1660 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacgggaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1661 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagaggcctgtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtagttcctcgggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacatccaggtcaaggaggtcacgcagaatgaaggcaccaagaccatcgccaataacctcaccagcaccatccaggtgtttacggactcggagtaccagcttccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1662 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggctgcaggcggtggcgcaccaatggcagacaataacgaaggcgccgacggagtgggtagttcctcgggaaattggcattgcgattccacatggatgggcgacagagtcatcaccaccagcacccgaacctgggccttgcccacctataacaaccatctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagcttggaccggctgatgaatcctctgattgaccagtacctgtactacttgtctcggactcaaacaacaggaggcacggcaaatacgcagactctgggtttcagccaaggtgggcctaatacaatggccaatcaggcaaagaactggctgcaaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaacctggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1663 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggagagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattcccaatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgctcacagccagagcttggaccggctgatgaatcctctgattgaccagtacctgtactacttgtctcggactcaaacaacaggaggcacggcaaatacgcagactttgggcttcagccaaggtgggcctaatacaatggccaatcaggcaaagaactgggtgccaggaccctgttaccgccaacaacgggtttcaacggcaaccgggcaaaacaacaatagcaactttgcctggactgctgggaccaaataccatctgaaaggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaaacgctggaacccagagattcaatacacttccaactactacaaatctacaagtgtggactttgctgttaatacagaaggcgtgtactctgaaccccaccccattggcacccgttacctcacccgtcccctgtaa

SEQ ID NO: 1664 - DNA, 2214 bp, Artificial Sequence
  Description of Artificial Sequence: Synthetic polynucleotide
  misc_feature (676)..(676): n is a, c, g, or t
  misc_feature (697)..(697): n is a, c, g, or t
  misc_feature (715)..(715): n is a, c, g, or t
  misc_feature (748)..(748): n is a, c, g, or t
  misc_feature (750)..(750): n is a, c, g, or t
  misc_feature (757)..(757): n is a, c, g, or t
  misc_feature (763)..(763): n is a, c, g, or t
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacgccctctggtgtgggacctaatacaatggctgcaggcggtggcgctccaatggcagacaataacgaaggcgccgacggagtgggtagttcctcangaaattggcattgcgattccncatggctgggcgacagantcatcaccaccagcacccgaacctgggccctgncnacctacnacaacnacctctacaagcaaatctccaacagcacatctggaggagccaccaacgacaacacctacttcggctacagcaccccctgggggtattttgactttaacagattccactgccacttttcaccacgtgactggcagcgactcatcaacaacaactggggattccggcctaagcgactcaacttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcaatacagcacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 1665 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacatgggccttgcccacctataacaaccacctctacaagcaaatctccagtgcttcaacgggggccagcaacgacaaccactacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacggacaatgatggagtcaagaccatcgccaataaccttaccagcacgattcaggtctttacggactcggaataccagttgccgtacgtcctcggctctgcgcaccagggctgcctgcctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacttttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcacgcaaagaactggctgccaggaccctgttaccgccaacaacgcgtctcaacgacaaccggacaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1666 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcacaaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcccaagagactcaacttcaaactcttcaacatccaagtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1667 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctccaagcgggtgacaatccgtacctgcggtataaccacgccgacgccgagtttcaggagcgtcttcaaggagatacgtcttttgggggcaacctcggacgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgatggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1668 - DNA, 2217 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgcggagtttcaggagcgccttaaagaagatacgtcttttgggggcaacctcggacgagcagtcttccaggcgaaaaagagggttcttgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattcccaatggctgggggacagagtcatcaccaccagcaccagaacctgggccctgcccacctacaacaatcacctctacaagcaaatctccaacagcacatctggaggatcttcaaatgacaacgcctacttcggctacagcaccccctgggggtattttgacttcaaccgcttccactgccacttctcaccacgtgactggcagcgactcatcaacaacaactggggattccggcccaagagactcaacttcaagctcttcaacattcaggtcaaagaggttacggacaacaatggagtcaagaccatcgccaataaccttaccagcacggtccaggtctttacggactcggagtaccagttgccgtacgtcctcggctctgcgcaccagggctgcctccctccgttcccggcggacgtgttcatgattccccagtacggctacctaacactcaacaacggtagtcaggccgtgggacgctcctccttctactgcctggaatatttcccttctcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggcaaagattccacacacggacggacattttcacccctctcccctcatgggtggattcggacttaaacaccctcctccacagattctcatcaagaacaccccggtacctgcgaatcctccgaccaccttcaaccagtcaaagctgaactctttcatcacgcaatacagcacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 1669 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaggcgggtgacaatccgtacctgcggtataaccacgccgacgccgagtttcaggagcgtctgcaagaagatacgtcttttgggggcaacctcgggcgagcagtcttccaggccaaaaagaggcttcttgaacctcttggtctggttgaggaaggggctaagacggctcctggaaagaaacgtccggtagagcagtcgccacaagagccagactcctcctcgggcattggcaagacaggccagcagcccgctaaaaagagactcaactttgggcagactggcgactcagagtcagtgcccgatcctcaacctctcggagaacctccagcaacccccgctgctgtgggacctactacaatggcttcaggcggtggcgcaccaatggcggacaataacgaaggcgccgatggagtgggtaattcctcgggaaattggcattgcgattccacatggatgggcgacagagtcatcaccaccagcacccgaacctgggccctgcccacctacaacaatcacctctacaagcaaatctccagtgcttcaacgggggccagcaacgacaaccactacttcggctacagcaccccctgggggtattttgatttcaacagattccactgccatttttcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggattcggaataccagctcccgtacgtcctcggctctgcgcaccagggctgcctccctccgttcccggcggacgtgttcattattccgcagtacggctacctaacgctcaacaatggtagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgccagtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1670 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaggcgggtgacaatccgtacctgcggtataaccacgccgacgccgagtttcaggagcgtctgcaagaagatacgtcttttgggggcaacctcgggcgagcagtcttccaggccaaaaagagggttcttgaaccttttggtctggttgaggaagctgctaagacggctcctggaaagaaacgtccggtagagcagtcgccacaagagccagactcctcctcgggcattggcaagacaggccagcagcccgctaaaaagagactcaattttggtcagactggcgactcagagtcagtgcccgaccctcaacctctcggagaacctccagcaacccccgctgctgtgggacctactacaatggcttcaggcggtggcgcaccaatggcagacaataacgaaggcgccgatggagtgggtaatgcctcaggaaattggcattgcgattccacatggctgggcgacagagtcatcaccaccagcacccgaacctgggccctgcccacctacaacaatcacctctacaagcaaatctccagtgcttcaacgggggccagcaacgacaaccactacttcggctacagcaccccctgggggtattttgactttaacagattccactgccacttttcaccacgtgactggcagcgactcatcaacaacaactggggattccggcccaagagactcaacttcaagctcttcaacatccaggtcaaggaggtcacgcagaatgaaggcaccaagaccatcgccaataacctcaccagcaccattcaggtctttacggattcggaataccagctcccgtacgtcctcggctctgcccaccagggctgcctccctccgttcccggcggacgtgttcatgattccgcagtacggctacctaacgctcaacaatggtagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcacgcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1671 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagcccgtcaacgaggcggacgcggcggccctcgaacacgacaaggcttacgaccagcagctcaaggccggtgacaacccctacctgcggtacaaccacgccgacgccgagttccaggagcggctgcaagaagatacgtcttttgggggcaacctcgggcgagcagtcttccaggccaagaagaggcttcttgaacctcttggtctggttgaggaagcggctaagacggctcctggaaagaagaggcctgtagagcagtctcctcaggaaccggactcctccgcgggtattggcaaatcaggtgcacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgatggagtgggtaatgcctcaggaaattggcattgcgattccacatggctgggcgacagagtcatcaccaccagcacccgaacctgggccctgcccacctataacaaccatctctacaagcaaatctccagtgcttcaacgggggccagtaacgacaaccactacttcggctacagcaccccctgggggtattttgactttaacagattccactgccacttctcaccacgtgactggcagcgactcatcaacaacaactggggattccggcccaagcgactcaacttcaagctcttcaacattcaggtcaaagaggttacggacaacgatggagtcaagaccatcgccaataaccttaccagcaccattcaggtgtttacggactcggaataccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaactggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1672 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaagcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttgggtctggttgaggaaggggctaagacggctcctggaaagaaaaggccggtagagcagtctcctcaggaaccggactcctccgcgggtattggcaagacaggtgcacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtagtgcctcgggaaattggcattgcgattccacatggctgggcgacagagtcatcaccaccagcacccgaacctgggccctgcccacctataacaaccatctctacaagcaaatctccagtgcttcaacgggggccagtaacgacaaccactacttcggctacagcaccccctgggggtattttgacttcaacagattccactgccacttctcaccacgtgactggcagcgactcatcaacaacaactggggattccggcccaagcgactcaacttcaagctcttcaacattcaggtcaaagaggttacggacaacaatggagtcaagaccatcgccaataaccttaccagcacgatccaggtctttacggactcggagtaccagctgccgtacgtcctcggctctgcgcaccagggctgcctgcctccgttcccggcggacgtgttcatgattccgcagtacggctacctaacgctcaacaatggtagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1673 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcggacgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctccagcagcgccctctggtgtgggacctaatacaatggctgcaggcggtggcgcaccaatggcagacaataacgaaggtgccgatggagtgggtagttcctcgggaaattggcattgcgattcccaatggctgggggacagagtcatcaccaccagcacccgaacctgggccctgcccacctataacaaccacctctacaagcaaatctccagtgcttcaacgggggccagcaacgacaaccactactttggctacagcaccccttgggggtattttgacttcaacagattccactgccacttttcaccacgtgactggcaaagactcatcaacaacaactggggattccgacccaagagactcaacttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcacgcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1674 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcaccagaacctgggccttgcccacctacaataaccacctctacaagcaaatctccaacagcacatctggaggatcttcaaatgacaacgcctacttcggctacagcaccccctgggggtattttgactttaacagattccactgccacttttcaccacgtgactggcagcgactcatcaacaacaactggggattccgacccaagagactcaacttcaagctcttcaacatccaggtcaaggaggtcacgcagaacgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacgctcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1675 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgcggagtttcaggagcgccttaaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagttccagaccctcaacctctcggagaacctccagcagcgccctctggtgtgggacctaatacaatggctgcaggcggtggcgcaccaatggcagacaataacgaaggtgccgatggagtgggtagttcctcgggaaattggcattgcgattcccaatggctggggaacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcccaagagactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcaatacggctacctgacgctcaacaacggtagccaagccgtgggacgttcatccttttactgcctggaatatttcccttctcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1676 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaggggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacctgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1677 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagaaaggccaacagcccgccagaaaaagactcaattttggtcagactggcgactcagagtcagttccagaccctcaacctctcggagaacctcccgcagccccctcaggtgtgggatctcttacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacttacaacaaccatctctacaagcaaatctccagtgcttcaacgggggccagcaacgacaaccactacttcggctacagcaccccctgggggtattttgatttcaacagattccactgccacttttcaccacgtgactggcaaagactcatcaacaacaactggggattccgacccaagagactcaacttcaagctctttaacattcaagtcaaagaggtcacgcagaatgaaggcaccaagaccatcgccaataaccttaccagcacggtccaggtcttcacggactcagactatcagctcccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctggaaccaaataccatctgaatggaagaaattcattgtctaatcctggcatcgctatggcgacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacatgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1678 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaggaagatacgtcttttgggggcaacctcgggcgagcagtcttccaggccaagaagagggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcggctcagagtcagtccccgacccacaacctctcggagaacctccagcaacccccgctgctgtgggacctactacaatggctgcaggcggtggcgcaccaatggcagacaataacgaaggcgccgacggagtgggtagttcctcgggaaattggcattgcgattccacatggctgggcgacagagtcatcaccaccagcaccagaacctgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcccaagagactcaacttcaaactcttcaacattcaggtcaaagaggttacggacaacaatggagtcaagaccatcgccaataaccttaccagcacggtccaggtgtttacggactcggagtaccagctgccgtacgttctcggctctgcccaccagggctgcctccctccgttcccggcggacgtgttcatgattccgcagtacggctacctaacgctcaacaatggcagccaggcagtgggacggtcatccttttactgcctggaatatttcccttctcagatgctgagaacgggcaacaactttaccttcagctacacctttgaggaagtgcctttccacagcagctacgcgcacagccagagcctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcctcacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1679 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQERLKEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1680 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKATNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1681 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGANTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMASHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTTNYYKSTSVDFAVNTEGVYSEPHPIGTRYLTRPL

SEQ ID NO: 1682 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1683 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFSDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1684 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRNL

SEQ ID NO: 1685 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1686 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMQDNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1687 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1688 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNLGSRPKRLNFKLFIIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 1689 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRLLEPLGLVEEAAKTAPGKKRPVEQSPQEPDSSSGIGKTGQQPAKKRLNFGQTGDSESVPDPQPIGEPPATPAAVGPTTMASGGGAPMADNNEGADGVGNSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSDPHPIGTRYLTRPL

SEQ ID NO: 1690 - protein, 736 aa, Artificial Sequence
  Description of Artificial Sequence: Synthetic polypeptide
MAADGYLPDWLEDNLSEGIREWWALKPGAPKPKANQQEQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPAAPSGVGPNTMAAGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFFCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1691 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQNSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTVPRPIGTRYLTRPL

SEQ ID NO: 1692 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRLLEPLGLVEEGAKTAPGKKRPVEQSPQEPDSSSGIGKTGEQPAKKRLNFGQTGDSESVPDPQPLGEPPATPAAVGPTTMASGGGAPMADNNEGADGVGSASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFPFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1693 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQDCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1694 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVILTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1695 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1696 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDRQLDSGDNPYLRYNHADAEFQERLKEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDRSVFFQYRDPDFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1697 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLKYNHADAEFQERLQGDTSFGGNLGRAVFQAKKRVLEPLGLVEEAAKTAPGKKRPVEQSPQEPDSSAGIGKSGAQPAKKRLNFGQTGDTESVPDPQPLGEPPAAPSGVGPNTMAAGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1698 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPFGLVEEAAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1699 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1700 - protein, 737 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1701 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLKYNHADAEFQERLQGDTSFGGNLGRAVFQAKKRVLEPLGLVEEAAKTAPGKKRPVEQSPQEPDSSAGIGKSGAQPAKKRLNFGQTGDTESVPDPQPLGEPPAAPSGVGPNTMAAGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFDKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1702 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDSESVPDPQPLGEPPATPAAVGPNTMATGSGAPMADNNEGADGVGNSSGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGKANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1703 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTGNTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1704 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1705 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMAAGGGAPMADNNEGADGVGSSSGNWHCDSTWMGDRVITTSTRTWALPTYNNHLYKQISSASTGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLQGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNLDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1706 - protein, 737 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSSGIGKTGQQPAKKRLNFGQTGDSESVPDPQPLGEPPATPAAVGPTTMASGGGAPMADNNEGADGVGNASGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWVPGPCYRQQRVSTATGQNNNSNFAWTAGTKYHLKGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1707 - protein, 737 aa, Artificial Sequence
  Description of Artificial Sequence: Synthetic polypeptide
  MOD_RES (226)..(226): Xaa can be any naturally occurring amino acid
  MOD_RES (233)..(233): Xaa can be any naturally occurring amino acid
  MOD_RES (239)..(239): Xaa can be any naturally occurring amino acid
  MOD_RES (250)..(250): Xaa can be any naturally occurring amino acid
  MOD_RES (253)..(253): Xaa can be any naturally occurring amino acid
  MOD_RES (255)..(255): Xaa can be any naturally occurring amino acid
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSSSGIGKTGQQPAKKRLNFGQTGDSESVPDPQPLGEPPATPSGVGPNTMAAGGGAPMADNNEGADGVGSSSXNWHCDSXWLGDRXITTSTRTWALXTYXNXLYKQISNSTSGGATNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEVQYTSNYAKSANVDFTVDNNGLYTEPRPIGTRYLTRPL

SEQ ID NO: 1708 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNDGVKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANHAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1709 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1710 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQGDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1711 - protein, 738 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNAADAAALEHDKAYDQQLKAGDNPYLRYNHADAEFQERLKEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGHFHPSPLMGGFGLKHPPPQILIKNTPVPANPPTTFNQSKLNSFITQYSTGQVSVEIEWELQKENSKRWNPEVQYTSNYAKSANVDFTVDNNGLYTEPRPIGTRYLTRPL

SEQ ID NO: 1712 - protein, 738 aa, Artificial Sequence; identical to SEQ ID NO: 1711
  Description of Artificial Sequence: Synthetic polypeptide

SEQ ID NO: 1713 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRLLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNSSGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFIIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1714 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEAAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANHAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1715 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNEADAAALEHDKAYDQQLKAGDNPYLRYNHADAEFQERLQEDTSFGGNLGRAVFQAKKRLLEPLGLVEEAAKTAPGKKRPVEQSPQEPDSSAGIGKSGAQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNDGVKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1716 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSAGIGKTGAQPAKKRLNFGQTGDSESVPDPQPLGEPPATPAAVGPTTMASGGGAPMADNNEGADGVGSASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1717 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGPNTMAAGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANHAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1718 - protein, 737 aa, Artificial Sequence; identical to SEQ ID NO: 1700
  Description of Artificial Sequence: Synthetic polypeptide

SEQ ID NO: 1719 - protein, 737 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLKEDTSFGGNLGRAVFQAKKRVLEPFGLVEEGAKTAPGKKRPVEQSPQEPDSSSGIGKTGQQPAKKRLNFGQTGDSESVPDPQPLGEPPAAPSGVGPNTMAAGGGAPMADNNEGADGVGSSSGNWHCDSQWLGNRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1720 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDRGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1721 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSLTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLSNPGIAMATHKDDKERFFPSNGILIFGKQNAARDNADYSDVMLTSEEEIKTTNPVATEEYGIVADNLQQQNTAPQIGTVNSQGALPGMVWQNRDMYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1722 - protein, 736 aa, Artificial Sequence
  Description of Artificial Sequence: Synthetic polynucleotide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGGSESVPDPQPLGEPPATPAAVGPTTMAAGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMASHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1723 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctgcatccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgccaaaaagagactcaatttcggtcagactggcggcacagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcaccagaacctgggccctgcccacttacaacaaccatctctacaagcaaatctccagtgcttcaacgggggccagcaacgacaaccactacttcggctacagcaccccctgggggtattttgatttcaacagattccactgccacttctcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggatacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1724 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggcgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattcccaatggctgggggacagagtcatcaccaccagcacccgaacctgggccctgcccacctacaacaatcacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1725 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttggaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacaggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1726 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagtctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgattttcggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcaccagatacctgactcgtaatctgtaa

SEQ ID NO: 1727 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcagtcgccacaagagccagactcctcctcgggcatcggcaagaaaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgatggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctg

SEQ ID NO: 1728 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccagcagctccaagcgggtgacaatccgtacctgcggtataaccacgccgacgccgagtttcaggagcgtcttcaaggagatacgtcttttgggggcaacctcggacgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaaccgcttccactgccacttctcaccacgtgactggcagcgactcatcaacaacaactggggattccggcccaagagactcagcttcaagctcttcaaccatccaggtcaaggaggtcacgcagaatgaaggcaccaagaccatcgccaataacctcaccagcacatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagttcacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattgggtaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctcatcaaaaacacacctgtacctgcggatcctccaacggccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1729 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacatggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaaactcttcaacatccaagtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgatccccaccccattggcacccgttacctcacccgtcccctgtaa

SEQ ID NO: 1730 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgaggcggacgcggcagccctcgaacacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgccagaaaaagactcaattttggtcagactggcgactcagagtcagttccagaccctcaacctctcggagaacctccagcagcgccctctggtgtgggacctaatacaatggcttcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaagcaaatctccagtgcttcaacgggggccagcaacgacaaccactacttcggctacagcaccccctgggggtattttgactttaacagattccactgccacttttcaccacgtgactggcagcgactcatcaacaacaactggggattccggcccaagagactcaacttcaagctcttcaacatccaagtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacacaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1731 - DNA, 2211 bp, Artificial Sequence
  Description of Artificial Sequence: Synthetic polynucleotide
  misc_feature (676)..(676): n is a, c, g, or t
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcagtcgccacaagagccagactcctcctcgggcatcggcaagaaaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgatggagtgggtaatgcctcangaaattggcattgcgattccacatggctgggcgacagagtcatcaccaccagcacccgaacatgggccttgccacctataacaaccacctctacaagcaaatctccagtgcttcaacgggggcgcagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacacagtactccacgggacaggtcagcgtggaaattgaatgggagctgcagaaggaaaacagcaagcgctggaacccggagatccagtacacttccaactactacaaatctacaaatgtggactttgctgttaacacagaaggcgtgtactctgaaccccaccccattggcacccgttacctcacccgtcccctgtaa

SEQ ID NO: 1732 - DNA, 2211 bp, Artificial Sequence
  Description of Artificial Sequence: Synthetic polynucleotide
  misc_feature (715)..(715): n is a, c, g, or t
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctccaagcgggtgacaatccgtacctgcggtataaccacgccgacgccgagtttcaggagcgtcttcaaggagatacgtcttttgggggcaacctcggacgagcagtcttccaggccaagaagcgggttctcgaacctctcggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctctggtgtgggacctaatacaatggctgcaggcggtggcgcaccaatggcagacaataacgaaggcgccgatggagtgggtagttcctcgggaaattggcattgcgattccacatggctgggcgacagantcatcaccaccagcacccgaacctgggccctgcccacctataacaaccatctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctgcctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacttttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccggacaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataactttcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1733 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaaaggagagccggtcaacgaggcggacgcggcagccctcgaacacgacaaagcttacgaccagcagctcaaggccggtgacaacccctacctcaagtataaccacgccgacgccgagtttcaggagcgtctgcaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagacccacaacctctcggagaacctccagcaacccccgctgctgtgggacctactacaatggcttcaggcggtggcgcaccaatggcggacaataacgaaggcgccgatggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1734 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccagcagctccaagcgggtgacaatccgtacctgcggtataaccacgccgacgccgagtttcaggagcgtcttcaaggagatacgtcttttgggggcaacctcggacgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacatgggccttgcccacctataacaaccacctctacaagcaaatctccagtgcttcaacgggggccagcaacgacaaccactacttcggctacagcaccccctgggggtattttgacttcaaccgcttccactgccacttctcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1735 - DNA, 2217 bp, Artificial Sequence
  Description of Artificial Sequence: Synthetic polynucleotide
atggctgccgatggttatcttccagattggctcgaggacaacctctctgagggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggggacagagtcatcaccaccagcacccgaacctgggccctgcccacctacaacaaccacctctacaagcaaatctccaacgggacttcgggaggaagcaccaacgacaacacctacttcggctgcgtcacgccctgggggtattttgactttaacaaattccactgccacttttcaccggatgactggcaacgactcatcaacaacggctggggattccggactaagcgactcaacttcaagctcttcagcatgaaagtcaaaaagggtacggacaacactggaatcaagaccatcgcgaataaccttaccaacacggtccatgtcttcgcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacctccaactactacaaatctacaagtgtggactttgctgttaatacagaaggcgtgtactctgaaccccaccccattggcacccgttacctcacccgtcccctgtaa

SEQ ID NO: 1736 - DNA, 2214 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgatggagtgggtagttcctcgggaaattggcattgcgattccacatggctgggggacagagtcatcaccaccagcacccgaacctgggccctgcccacctacaacaaccacctctacaaacaaatttccagcgcttcaacgggagcctcgaacgacaatcactactttggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccgtctcatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacctgcagcagcaaaacacggctcctcaaattggaactgtcaacagccagggggccttacccggtatggtctggcagaaccgggacgtgtacctgcagggtcccatctgggccaagattcttcacacggacggcaactttcacccttctccgctgatgggagggtttggaatgaagcacccgcctcctccgatcctgatcaagaacacgcctgtacctgcggatcctccgaccaccttcaaccagtcaaagctgaactctttcatcacgcaatacagcaccggacaggtcagcgtggaaattgaatgggagctgccgaaggaaaacagcaagcgctggaaccccgagatccagtacacctccaactactacaaatctacaagtgtggactttgctgttaatacagaaggtgtgtactatgaaccccaccccattggcacccgttacctcacccctcccctgtaa

SEQ ID NO: 1737 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgctctccagactcctctacgggcatcggcaagaaaggccaacagcccgccagaaaaagactcaattttggtcagactggcgactcagagtcagttccagaccctcaacctctcggagaacctccagcagcgccctctggtgtggcacctaatacaatggctgcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccacttttcaccacgtgactggcagcgactcatcacaacaattgggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggacgttcctttccacagcagctacgctcacagccagagtctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1738 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcggacgagcagtcttccaggcgaaaaagagggttcttgaacctctgggcctggttgaggaacctgttaagacggctccgggaaaaaagaggccggtagagcagtcgccacaagagccagactcctcctcgggcatcggcaagaaaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggatgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgactttaacagattccactgccacttttcaccacgtgactggcagcgactcatcaacaacaactggggattccggcctaagcgactcaacttcaagctcttcaacattcaggtcaaggaggtcacgcagaatgaaggcaccaagaccatcgccaataacctcaccagcaccatccaggtgtttacggactcggagtaccagctgccgtacgttctcggctccgcccaccagggctgcctgcctccgttcccggcggacgtgttcatgatcccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcacgcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggcttcggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1739 - DNA, 2214 bp, Artificial Sequence
  Description of Artificial Sequence: Synthetic polynucleotide
atggctgccgatggttatcttccagattggctcgaggacaacctctctcagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcggacgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgcccgctgctgtgggacctactacaatggcttcaggcggtggcgcaccaatggcagacaataacgaaggcgccgacggagtgggtagttcctcgggaaattggcattgcgattcccaatggctgggggacagagtcatcaccaccagcacccgaacctgggccctgcccacctacaacaaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacgggtacctgactctgaacaatggcagtcaggccgtgggccgttcctccttctactgcctggagtactttccttctcaaatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatgcgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacacagtactccacgggacaggtcagcgtggaaattgaatgggagctgcagaaggaaaacagcaagcgctggaacccggagatccagtacacttccaactactacaaatctacaaatgtggactttgctgttaacacagaaggcgtgtactctgaaccccaccccattggcacccgttacctcacccgtcccctgtaa

SEQ ID NO: 1740 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaatttcggtcagactggcgacacagagtcagtcccagaccctcaaccaatcggagaacctcccgcagccccctcaggtgtgggacctaatacaatggctgcaggcggtggcgcaccaatggcagacaataacgaaggcgccgacggagtgggtagttcctcgggaaattggcattgcgattccacatggatgggtgacagagtcatcaccaccagcacccgaacctgggccctgcccacctacaataaccacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacacagtactccacgggacaggtcagcgtggaaattgaatgggagctgcagaaggaaaacagcaagcgctggaacccggagatccagtacacttccaactactacaaatctacaaatgtggactttgctgttaacacagaaggcgtgtactctgaaccccaccccattggcacccgttacttcacccgtcccctgtaa

SEQ ID NO: 1741 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaaaagactcaattttggtcagactggcgactcagagtcagttccagaccctcaacctctcggagaacctccagcaacccccgctgctgtgggacctactacaatggcttcaggtggtggcgcaccaatggcagacaataacgagggcgccgacggagtgggtaattcctcgggaaattggcattgcgattccacatggatgggcgacagagtcatcaccaccagcacccgaacctgggccctgcccacctacaacaatcacctctacaagcaaatctccagtgcttcaacgggggccagcaacgacaaccactacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggagtaccagttgccgtacgtcctcggctctgcgcaccagggctgcctccctccgttcccggcggacgtgttcatgattccgcagtacggctacctaacgctcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcgacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacacagtactccacgggacaggtcagcgtggaaattgaatgggagctgcagaaggaaaacagcaagcgctggaacccggagatccagtacacttccaactactacaaatctacaaatgtggactttgctgttaacacagaaggcgtgtactctgaaccccaccccattggcacccgttacctcacccgtcccctgtaa

SEQ ID NO: 1742 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcaccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcggacaataacgaaggcgccgatggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctgactctgaacaatggcagtcaggccgtgggccgttcctccttctactgcctagagtactttccttctcaaatgctgagaacgggcaacaactttgagttcagctaccagtttgaggacgtgccttttcacagcagctacgcgcacagccaaagcctggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatatgaatggaagaaattcattggttaatcctggcatcgctatggcaacacacaaagacgacaaggagcgtttttttcccagtaacgggatcctgatttttggcaaacaaaatgttgccagagacaatgcggattacagcgatgtcatgctcaccagcgaggaagaaatcaaaaccactaaccctgtggctacagaggaatacggtattgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtcgccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 1743 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEQSPQEPDSSSGIGKKGQQPAKKRLNFGQTGDSESVPDPQPLGEPPATPAAVGPTTMASGGGAPMADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKRLNFRLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1744 - protein, 736 aa, Artificial Sequence
  Description of Artificial Sequence: Synthetic polypeptide
MAADGYLPDWLEDNLSEGIREWWDLKPASPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRLLEPLGLVEEAAKTAPGKKRPVEQSPQEPDSSAGIGKSGAQPAKKRLNFGQTGGTESVPDPQPLGEPPAAPSGVGPNTMAAGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1745 - protein, 736 aa, Artificial Sequence; identical to SEQ ID NO: 1684
  Description of Artificial Sequence: Synthetic polypeptide

SEQ ID NO: 1746 - protein, 736 aa, Artificial Sequence
  Description of Artificial Sequence: Synthetic polypeptide
MAADGYLPDWLEDNLSEGIREWWDLEPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1747 - protein, 736 aa, Artificial Sequence; identical to SEQ ID NO: 1684
  Description of Artificial Sequence: Synthetic polypeptide

SEQ ID NO: 1748 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEQSPQEPDSSSGIGKKGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1749 - protein, 734 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLQAGDNPYLRYNHADAEFQERLQGDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNHPGQGGHAERHQDHRQPHQHIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLGNPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTAFNQSKLNSFITQYSTGQVSVEIEWELQKENSKRWNPEIQYTSNYYKSTSVDFAVNTEGVYSEPHPIGTRYLTRPL

SEQ ID NO: 1750 - protein, 737 aa, Artificial Sequence
  Description of Artificial Sequence: Synthetic polypeptide
MAADGYLPDWLEDNLSEGIREWWDLKHGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSDPHPIGTRYLTRPL

SEQ ID NO: 1751 - protein, 737 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMASGGGAPMADNNEGADGVGNSSGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1752 - protein, 736 aa, Artificial Sequence
  Description of Artificial Sequence: Synthetic polypeptide
  MOD_RES (226)..(226): Xaa can be any naturally occurring amino acid
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEQSPQEPDSSSGIGKKGQQPAKKRLNFGQTGDSESVPDPQPLGEPPATPAAVGPTTMASGGGAPMADNNEGADGVGNASXNWHCDSTWLGDRVITTSTRTWALPPITTTSTSKSPVLQRGRSNDNHYFGYSTPWGYFDFNRFHCHFSPRDWQRLINNNWGFRPKRLNFKLFNIQVKEVTDNNGVKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTNVDFAVNTEGVYSEPHPIGTRYLTRPL

SEQ ID NO: 1753 - protein, 736 aa, Artificial Sequence
  Description of Artificial Sequence: Synthetic polypeptide
  MOD_RES (239)..(239): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLQAGDNPYLRYNHADAEFQERLQGDTSFGGNLGRAVFQAKKRVLEPLGLVEEAAKTAPGKKRPVEQSPQEPDSSAGIGKSGAQPAKKRLNFGQTGDTESVPDPQPIGEPPAAPSGVGPNTMAAGGGAPMADNNEGADGVGSSSGNWHCDSTWLGDRXITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNFQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1754 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNEADAAALEHDKAYDQQLKAGDNPYLKYNHADAEFQERLQEDTSFGGNLGRAVFQAKKRLLEPLGLVEEAAKTAPGKKRPVEQSPQEPDSSAGIGKSGAQPAKKRLNFGQTGDTESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1755 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLQAGDNPYLRYNHADAEFQERLQGDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1756 - protein, 738 aa, Artificial Sequence
  Description of Artificial Sequence: Synthetic polypeptide
MAADGYLPDWLEDNLSEGIRQWWKLKPGPPPPKPAERHKDDSRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISNGTSGGSTNDNTYFGCVTPWGYFDFNKFHCHFSPDDWQRLINNGWGFRTKRLNFKLFSMKVKKGTDNTGIKTIANNLTNTVHVFADSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1757 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKILHTDGNFHPSPLMGGFGMKHPPPPILIKNTPVPADPPTTFNQSKLNSFITQYSTGQVSVEIEWELPKENSKRWNPEIQYTSNYYKSTSVDFAVNTEGVYYEPHPIGTRYLTPPL

SEQ ID NO: 1758 - protein, 737 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVAPNTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLITTIGGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1759 - protein, 736 aa, Artificial Sequence
  Description of Artificial Sequence: Synthetic polypeptide
MAADGYLPDWLEDTLSEGIRQWWKLKPGPPPPKPAERHKDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEPVKTAPGKKRPVEQSPQEPDSSSGIGKKGQQPAKKRLNFGQTGDSESVPDPQPLGEPPATPAAVGPTTMASGGGAPMADNNEGADGVGNASGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANHAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1760 - protein, 737 aa, Artificial Sequence
  Description of Artificial Sequence: Synthetic polypeptide
MAADGYLPDWLEDNLSQGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNAQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTNVDFAVNTEGVYSEPHPIGTRYLTRPL

SEQ ID NO: 1761 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDTESVPDPQPIGEPPAAPSGVGPNTMAAGGGAPMADNNEGADGVGSSSGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTNVDFAVNTEGVYSEPHPIGTRYFTRPL

SEQ ID NO: 1762 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNSSGNWHCDSTWMGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTNVDFAVNTEGVYSEPHPIGTRYLTRPL

SEQ ID NO: 1763 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHMNGRNSLVNPGIAMATHKDDKERFFPSNGILIFGKQNVARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 1764 - DNA, 2217 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 1765 - protein, 738 aa, Artificial Sequence; identical to SEQ ID NO: 105
  Description of Artificial Sequence: Synthetic polypeptide

SEQ ID NO: 1766 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1767 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYLIPATGSDSLIRYETHSTLDGRWSALTPGPPMATAGPADSKFSNSQLIFAGPKQNGNTATVPGTLIFTSEEELAATNATDTDMWGNLPFRDLSSSNLPTVDRSTPLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1768 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYYIPATGSDSLILYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1769 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYGIPATGSDSLIKYETHSTLDGRWSALTPGPPIATAGPADSKFSNSQLIFAGPKQNGNTATVPGTLIFTSEEELAATNATDTDMWGNLPLYDASSSNLPTVDRLTLLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1770 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYTIPATGSDSLITYETHSTLDGRWSALTPGPPGATAGPADSKFSNSQLIFAGPKQNGNTATVPGTLIFTSEEELAATNATDTDMWGNLPRVDTSASNLPTVDRYTNLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1771 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYSIPATGSDSLIKYETHSTLDGRWSALTPGPPFATAGPADSKFSNSQLIFAGPKQNGNTATVPGTLIFTSEEELAATNATDTDMWGNLPDYDSSLSNLPTVDRDTTLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1772 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYSIPATGSDSLIWYETHSTLDGRWSALTPGPPCATAGPADSKFSNSQLIFAGPKQNGNTATVPGTLIFTSEEELAATNATDTDMWGNLPQGDSSLSNLPTVDRMTVLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1773 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYCIPATGSDSLIRYETHSTLDGRWSALTPGPPLATAGPADSKFSNSQLIFAGPKQNGNTATVPGTLIFTSEEELAATNATDTDMWGNLPYKDSSRSNLPTVDRETSLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1774 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYIIPATGSDSLIYYETHSTLDGRWSALTPGPPRATAGPADSKFSNSQLIFAGPKQNGNTATVPGTLIFTSEEELAATNATDTDMWGNLPWIDNSRSNLPTVDRPTSLGAVPGMVWQNKNIYYQGPIWAKIPHTDGHFHPSPLIGGFGLKHPPPQIFIKNTPVPANPATTFTSTPVNSFITQYSTGQVSVQIDWEIQKERSKRWNPEVQFTSNYGQQNSLLWAPDAAGKYTEPRAIGTRYLTHHL

SEQ ID NO: 1775 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYGIPATGSDSLIIYETHSTLDGRWSALTPGPPRATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1776 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYVIPATESDSLIYYETHSTLDGRWSALTPGPPYATAGPADSKFSNSQLIFAGPKQNGNTATVPGTLIFTSEEELAATNATDTDMWGNLPPRDDSTSNLPTVDRKTYLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1777 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYYIPATGSDSLIIYETHSTLDGRWSALTPGPPIATAGPADSKFSNSQLIFAGPKQNGNTATVPGTLIFTSEEELAATNSTDTDMWGNLPTDDDSRSNLPTVDRMTLLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1778 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYHIPATGSDSLIYYETHSTLDGRWSALTPGPPSATAGPADSKFSNSQLIFAGPKQNGNTATVPGTLIFTSEEELAATNATDTDMWGNLPRRDSSVSNLPTVDRYTDLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1779 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYSIPATGSDSLISYETHSTLDGRWSALTPGPPRATAGPADSKFSNSQLIFAGPKQNGNTATVPGTLIFTSEEELAATNATDTDMWGNLPRHDSSLSNLPTVDRNTGLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1780 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYFIPATGSDSLIRYETHSTLDGRWSALTPGPPLATAGPADSKFSNSQLIFAGPKQNGNTATVPGTLIFTSEEELAATNATDTDMWGNLPVIDFSKSNLPTVDRLTHLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1781 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPVRDFSLSNLPTVDRTTKLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1782 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYFIPATGSDSLIQYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1783 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEMPATGSDSLIIYETHSTLDGRWSALTPGPPFATAGPADSKFSNSQLIFAGPKQNGNTATVPGTLIFTSEEELAATNATDTDVWGNLPSGDHSQSNLPTVDRPTMLGAVPGMVWQNRDIYYQGPIWAKIPHTDGHFHPSPLIGGFGLKHPPPQIFIKNTPVPANPATTFISTPVNSFITQYSTGQVSVHIDWEIQKERSKRWNPEVQFTSDYGQHSSLLWAPDAAGKYTEPTAIGTRYLTHHL

SEQ ID NO: 1784 - protein, 734 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNDIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1785 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYIIPATGSDSLITYETHSTLDGRWSALTPGPPVATAGPADSKFSNSQLIFAGPKQNGNTATVPGTLIFTSEEELAATNATDTDMWGNLPFNDDSSSNLPTVDRSTFLGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1786 - protein, 733 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPARKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSSSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 1787 - protein, 742 aa, Artificial Sequence; identical to SEQ ID NO: 1598
  Description of Artificial Sequence: Synthetic polypeptide

SEQ ID NO: 1788 - protein, 733 aa, Artificial Sequence; identical to SEQ ID NO: 421
  Description of Artificial Sequence: Synthetic polypeptide

SEQ ID NO: 1789 - protein, 733 aa, Artificial Sequence; identical to SEQ ID NO: 138
  Description of Artificial Sequence: Synthetic polypeptide

SEQ ID NO: 1790 - protein, 733 aa, Artificial Sequence; identical to SEQ ID NO: 425
  Description of Artificial Sequence: Synthetic polypeptide

SEQ ID NO: 1791 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1792 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPVVRGLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1793 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPVVNRLSALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1794 - protein, 735 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPPVMGLGALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1795 - protein, 736 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSRVDRLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1796 - protein, 736 aa, Artificial Sequence
  Description of Artificial Sequence: Synthetic polypeptide
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSRALRLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 1797 - DNA, 1172 bp, Artificial Sequence
  Description of Artificial Sequence: Synthetic polynucleotide
cttaattaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctaccagggtaatggggatcctctagaactatagctagtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgtcgaggccacgttctgcttcactctccccatctcccccccctccccacccccaattttgtatttatttattttttaattattttgtgcagcgatgggggcggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagcaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcsactatagg

SEQ ID NO: 1798 - DNA, 3231 bp, Artificial Sequence
  Description of Artificial Sequence: Synthetic polynucleotide
taagaattcacgcgtggtacctctagagtcgacccgggcggcctcgaggacggggtgaactacgcctgaggatccgatctttttccctctgccaaaaattatggggacatcatgaagccccttgagcatctgacttctggctaataaaggaaatttattttcattgcaatagtgtgttggaattttttgtgtctctcactcggaagcaattcgttgatctgaatttcgaccacccataatacccattaccctggtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggc

SEQ ID NO: 1799 - protein, 737 aa, Artificial Sequence
  Description of Artificial Sequence: Synthetic polypeptide
  MOD_RES (264)..(264): Xaa can be any naturally occurring amino acid
  MOD_RES (266)..(266): Xaa can be any naturally occurring amino acid
  MOD_RES (268)..(268): Xaa can be any naturally occurring amino acid
  MOD_RES (448)..(448): Xaa can be any naturally occurring amino acid
  MOD_RES (459)..(460): Xaa can be any naturally occurring amino acid
  MOD_RES (467)..(467): Xaa can be any naturally occurring amino acid
  MOD_RES (470)..(471): Xaa can be any naturally occurring amino acid
  MOD_RES (474)..(474): Xaa can be any naturally occurring amino acid
  MOD_RES (495)..(495): Xaa can be any naturally occurring amino acid
  MOD_RES (516)..(516): Xaa can be any naturally occurring amino acid
  MOD_RES (533)..(533): Xaa can be any naturally occurring amino acid
  MOD_RES (547)..(547): Xaa can be any naturally occurring amino acid
  MOD_RES (551)..(551): Xaa can be any naturally occurring amino acid
  MOD_RES (555)..(555): Xaa can be any naturally occurring amino acid
  MOD_RES (557)..(557): Xaa can be any naturally occurring amino acid
  MOD_RES (561)..(561): Xaa can be any naturally occurring amino acid
  MOD_RES (563)..(563): Xaa can be any naturally occurring amino acid
  MOD_RES (577)..(577): Xaa can be any naturally occurring amino acid
  MOD_RES (583)..(583): Xaa can be any naturally occurring amino acid
  MOD_RES (593)..(593): Xaa can be any naturally occurring amino acid
  MOD_RES (596)..(596): Xaa can be any naturally occurring amino acid
  MOD_RES (661)..(662): Xaa can be any naturally occurring amino acid
  MOD_RES (664)..(665): Xaa can be any naturally occurring amino acid
  MOD_RES (710)..(710): Xaa can be any naturally occurring amino acid
  MOD_RES (717)..(719): Xaa can be any naturally occurring amino acid
  MOD_RES (723)..(723): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPLGEPPAGPSGLGSGTMAAGGGAPMADNNEGADGVGNASGNWHCDSTWLGDRVITTSTRTWALPTYNNHLYKQISSXSXGXTNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLXRTQSTGGTAGXXELLFSQXGPXXMSXQAKNWLPGPCYRQQRVSKTLXQNNNSNFAWTGATKYHLNGRXSLVNPGVAMATHKDDEXRFFPSSGVLIFGKXGAGXNNTXLXNVMXTXEEEIKTTNPVATEXYGVVAXNLQSSNTAPXTGXVNSQGALPGMVWQNRDVYLQGPIWAKIPHTDGNFHPSPLMGGFGLKHPPPQILIKNTPVPANPPXXFXXAKFASFITQYSTGQVSVEIEWELQKENSKRWNPEIQYTSNYAKSXNVDFAVXXXGVYXEPRPIGTRYLTRNL

SEQ ID NO: 1800 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPLGEPPAGPSGLGSGTMAAGGGAPMADNNEGADGVGNASGNWHCDSTWLGDRVITTSTRTWALPTYNNHLYKQISSASSGSTNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLARTQSTGGTAGNRELLFSQGGPSNMSAQAKNWLPGPCYRQQRVSKTLAQNNNSNFAWTGATKYHLNGRDSLVNPGVAMATHKDDEDRFFPSSGVLIFGKEGAGANNTALENVMLTNEEEIKTTNPVATEQYGVVASNLQSSNTAPATGAVNSQGALPGMVWQNRDVYLQGPIWAKIPHTDGNFHPSPLMGGFGLKHPPPQILIKNTPVPANPPATFTPAKFASFITQYSTGQVSVEIEWELQKENSKRWNPEIQYTSNYAKSTNVDFAVNNEGVYSEPRPIGTRYLTRNL

SEQ ID NO: 1801 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPLGEPPAGPSGLGSGTMAAGGGAPMADNNEGADGVGNASGNWHCDSTWLGDRVITTSTRTWALPTYNNHLYKQISSQSSGSTNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQSTGGTAGNRELLFSQGGPANMSAQAKNWLPGPCYRQQRVSKTLSQNNNSNFAWTGATKYHLNGRDSLVNPGVAMATHKDDEERFFPSSGVLIFGKQGAGANNTTLDNVMMTSEEEIKTTNPVATEQYGVVASNLQSSNTAPQTGTVNSQGALPGMVWQNRDVYLQGPIWAKIPHTDGNFHPSPLMGGFGLKHPPPQILIKNTPVPANPPAVFSPAKFASFITQYSTGQVSVEIEWELQKENSKRWNPEIQYTSNYAKSTNVDFAVNSEGVYSEPRPIGTRYLTRNL

SEQ ID NO: 1802 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPLGEPPAGPSGLGSGTMAAGGGAPMADNNEGADGVGNASGNWHCDSTWLGDRVITTSTRTWALPTYNNHLYKQISSASSGSTNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLARTQSTGGTAGTRELLFSQGGPSNMSAQAKNWLPGPCYRQQRVSKTLTQNNNSNFAWTGATKYHLNGRDSLVNPGVAMATHKDDEDRFFPSSGVLIFGKQGAGANNTALDNVMITNEEEIKTTNPVATEQYGVVASNLQSSNTAPATGTVNSQGALPGMVWQNRDVYLQGPIWAKIPHTDGNFHPSPLMGGFGLKHPPPQILIKNTPVPANPPTVFSPAKFASFITQYSTGQVSVEIEWELQKENSKRWNPEIQYTSNYAKSTNVDFAVNSEGVYTEPRPIGTRYLTRNL

SEQ ID NO: 1803 - protein, 737 aa, Artificial Sequence
  Description of Artificial Sequence: Synthetic polypeptide
  MOD_RES (264)..(264): Xaa can be any naturally occurring amino acid
  MOD_RES (448)..(448): Xaa can be any naturally occurring amino acid
  MOD_RES (459)..(459): Xaa can be any naturally occurring amino acid
  MOD_RES (470)..(470): Xaa can be any naturally occurring amino acid
  MOD_RES (495)..(495): Xaa can be any naturally occurring amino acid
  MOD_RES (533)..(533): Xaa can be any naturally occurring amino acid
  MOD_RES (547)..(547): Xaa can be any naturally occurring amino acid
  MOD_RES (555)..(555): Xaa can be any naturally occurring amino acid
  MOD_RES (557)..(557): Xaa can be any naturally occurring amino acid
  MOD_RES (561)..(561): Xaa can be any naturally occurring amino acid
  MOD_RES (563)..(563): Xaa can be any naturally occurring amino acid
  MOD_RES (593)..(593): Xaa can be any naturally occurring amino acid
  MOD_RES (596)..(596): Xaa can be any naturally occurring amino acid
  MOD_RES (661)..(662): Xaa can be any naturally occurring amino acid
  MOD_RES (664)..(664): Xaa can be any naturally occurring amino acid
  MOD_RES (718)..(718): Xaa can be any naturally occurring amino acid
  MOD_RES (723)..(723): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPLGEPPAGPSGLGSGTMAAGGGAPMADNNEGADGVGNASGNWHCDSTWLGDRVITTSTRTWALPTYNNHLYKQISSXSSGSTNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLXRTQSTGGTAGXRELLFSQGGPXNMSAQAKNWLPGPCYRQQRVSKTLXQNNNSNFAWTGATKYHLNGRDSLVNPGVAMATHKDDEXRFFPSSGVLIFGKXGAGANNTXLXNVMXTXEEEIKTTNPVATEQYGVVASNLQSSNTAPXTGXVNSQGALPGMVWQNRDVYLQGPIWAKIPHTDGNFHPSPLMGGFGLKHPPPQILIKNTPVPANPPXXFXPAKFASFITQYSTGQVSVEIEWELQKENSKRWNPEIQYTSNYAKSTNVDFAVNXEGVYXEPRPIGTRYLTRNL

SEQ ID NO: 1804 - protein, 737 aa, Artificial Sequence
  Description of Artificial Sequence: Synthetic polypeptide
  MOD_RES (264)..(264): Xaa can be any naturally occurring amino acid
  MOD_RES (448)..(448): Xaa can be any naturally occurring amino acid
  MOD_RES (470)..(470): Xaa can be any naturally occurring amino acid
  MOD_RES (533)..(533): Xaa can be any naturally occurring amino acid
  MOD_RES (547)..(547): Xaa can be any naturally occurring amino acid
  MOD_RES (555)..(555): Xaa can be any naturally occurring amino acid
  MOD_RES (557)..(557): Xaa can be any naturally occurring amino acid
  MOD_RES (561)..(561): Xaa can be any naturally occurring amino acid
  MOD_RES (563)..(563): Xaa can be any naturally occurring amino acid
  MOD_RES (593)..(593): Xaa can be any naturally occurring amino acid
  MOD_RES (596)..(596): Xaa can be any naturally occurring amino acid
  MOD_RES (662)..(662): Xaa can be any naturally occurring amino acid
  MOD_RES (664)..(664): Xaa can be any naturally occurring amino acid
  MOD_RES (718)..(718): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPLGEPPAGPSGLGSGTMAAGGGAPMADNNEGADGVGNASGNWHCDSTWLGDRVITTSTRTWALPTYNNHLYKQISSXSSGSTNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLXRTQSTGGTAGNRELLFSQGGPXNMSAQAKNWLPGPCYRQQRVSKTLSQNNNSNFAWTGATKYHLNGRDSLVNPGVAMATHKDDEXRFFPSSGVLIFGKXGAGANNTXLXNVMXTXEEEIKTTNPVATEQYGVVASNLQSSNTAPXTGXVNSQGALPGMVWQNRDVYLQGPIWAKIPHTDGNFHPSPLMGGFGLKHPPPQILIKNTPVPANPPAXFXPAKFASFITQYSTGQVSVEIEWELQKENSKRWNPEIQYTSNYAKSTNVDFAVNXEGVYSEPRPIGTRYLTRNL

SEQ ID NO: 1805 - DNA, 2217 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 1806 - protein, 733 aa, Artificial Sequence; identical to SEQ ID NO: 1591
  Description of Artificial Sequence: Synthetic polypeptide

SEQ ID NO: 1807 - DNA, 2203 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcaggtggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaa

SEQ ID NO: 1808 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQVATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1809 - DNA, 2203 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacggtcaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaa

SEQ ID NO: 1810 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTVNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1811 - DNA, 2203 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacacccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaa

SEQ ID NO: 1812 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNTQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1813 - DNA, 2203 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacggtcaacacccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaa

SEQ ID NO: 1814 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTVNTQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1815 - DNA, 2203 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggccgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaa

SEQ ID NO: 1816 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSAVPVSSFITQYSTGQVTVEMEWELKKENSKRWNPEIQYTNNYNDPQFVDFAPDSTGEYRTTRPIGTRYLTRPL

SEQ ID NO: 1817 - DNA, 2203 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttatggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaa

SEQ ID NO: 1818 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFMDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1819 - DNA, 2203 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtcgatgtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaa

SEQ ID NO: 1820 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVDVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1821 - DNA, 2203 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggacccagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaa

SEQ ID NO: 1822 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTQGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1823 - DNA, 2203 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagtcggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaa

SEQ ID NO: 1824 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQSANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1825 - DNA, 2203 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagggggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaa

SEQ ID NO: 1826 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQGANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1827 - DNA, 2194 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcgggaagcaaggctcagagaaaacaaatgtggacattgaaaaggtcatgatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaa

SEQ ID NO: 1828 - protein, 721 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFGKQGSEKTNVDIEKVMITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1829 - protein, 519 aa, Artificial Sequence
  Description of Artificial Sequence: Synthetic polypeptide
DGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 1830 - protein, 738 aa, Artificial Sequence
  Description of Artificial Sequence: Synthetic polypeptide
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 1831 - protein, 725 aa, Artificial Sequence
  Description of Artificial Sequence: Synthetic polypeptide
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1832 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 1833 - protein, 735 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRPL

SEQ ID NO: 1834 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISSQSGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQGTTASNAELDNVMITDEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYNKSVNVDFTVDTNGVYSEPRPIGTRYLTRNL

SEQ ID NO: 1835 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISSQSGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 1836 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDTESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMASQARNWVPGPSYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 1837 - DNA, 3695 bp, Artificial Sequence
  Description of Artificial Sequence: Synthetic polynucleotide
ctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgaatttagcggccgcgaattcgcccttatgatatctggtgggaggagggcaagatgacggccaaggtcgtggagtccgccaaggccattctcggcggcagcaaagtgcgcgtggaccaaaagtgcaagtcgtccgcccagatcgatcccactcccgtcattgtcacctccaacaccaacatgtgcgccgtgattgacgggaacagcaccaccttcgagcaccagcagccgttgcaggaccggatgttcaaatttgaacttacccgccgtctggagcatgactttggcaaggtgacaaagcaggaagtcaaagagttcttccgctgggcgcaggatcacgtgaccgaggtggcgcatgagttccacgtcagaaagggtggagccaacaagagacccgcccccgatgacgctgataaaagcgagcccaagcgggcctgcccctcagtcgcagatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagggactgttcggagtgcttccccggcgtgtcagaatctcaaccggtcgtcagaaaaaggacgtatcggaaactctgtgccattcatcatctgctggggagggctcccgagattgcttgctcggcctgcgatctggtcaacgtggacctggatgactgtgtctctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcaccccaagaaccagactcctcatcgggcatcggcaagacaggccagcagcccgctaaaaagagactcaattttggtcagactggcgacacagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctactttggctacagcaccccctgggggtattttgacttcaacagattccactgccacttttcaccacgtgactggcagcgactcatcaacaacaattggggattccggcccaagagactcaacttcaagctcttcaacatccaggtcaaggaagtcacgacgaacgaaggcaccaagaccatcgccaataatctcaccagcaccgtgcaggtctttacggactcggagtaccagctaccgtacgtgctaggatcagctcaccagggatgtctgcctccgttcccggcggacgtcttcatggttcctcagtacggttatctaactctgaacaatggcagccaggccctgggacgttcctccttctactgcctggagtatttcccatcgcagatgctgagaaccggcaacaactttcagttcagctacaccttcgaggacgtgcctttccacagcagctacgcgcacagccaaagcctggacaggctgatgaatcccctcatcgaccagtacctgtattacctggtcagaacgcagacaaccgggactggagggacgcagactctggcattcagccaagcaggccctagctcaatggccagccaggctagaaactgggtgcccggaccgagctaccggcagcagcgcgtctccacgacaaccaaccagaacaacaacagcaactttgcctggacgggagctgccaaatttaaactgaacggccgagactctctaatgaaccccggcgtggccatggcttcacacaaggatgacgaggaccgcttcttcccttctagcggggtcctgattttcggcaagcaaggagccgggaatgatggagtggattacagccaagtgctgattacagatgaggaagaaatcaaggctaccaaccccgtggcaacagaggaatatggagcagtggccatcaacaaccaggccgctaatacgcaggcgcagaccggactcgtgcacaaccagggggtgattcccggcatggtgtggcagaacagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcagtacacttccaactactacaaatctacaaatgtggactttgctgtcaacacggaaggagtgtatagcgagcctcgccccattggcacccgttacctcacccgcaacctgtaattgcctgttaatcaataaaccggttaattcgtttcagtaaggaagaattcgtttaaa

SEQ ID NO: 1838 - protein, 736 aa, Artificial Sequence; identical to SEQ ID NO: 507
  Description of Artificial Sequence: Synthetic polypeptide

SEQ ID NO: 1839 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDTESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSNMASQARNWVPGPSYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 1840 - protein, 738 aa, Artificial Sequence; identical to SEQ ID NO: 1534
  Description of Artificial Sequence: Synthetic polypeptide

SEQ ID NO: 1841 - protein, 736 aa, Artificial Sequence
  Description of Artificial Sequence: Synthetic polypeptide
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRPL

SEQ ID NO: 1842 - protein, 736 aa, Artificial Sequence
  Description of Artificial Sequence: Synthetic polypeptide
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKVANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFVPAKFASFITQYSTGQVSVEIEWELQKENSKRWNPEIQYTSNYNKSVNVDFTVDTNGVYSEPRPIGTRYLTRPL

SEQ ID NO: 1843 - protein, 736 aa, Artificial Sequence
  Description of Artificial Sequence: Synthetic polypeptide
  MOD_RES (168)..(168): Xaa can be any naturally occurring amino acid
  MOD_RES (204)..(204): Xaa can be any naturally occurring amino acid
  MOD_RES (266)..(266): Xaa can be any naturally occurring amino acid
  MOD_RES (311)..(311): Xaa can be any naturally occurring amino acid
  MOD_RES (411)..(411): Xaa can be any naturally occurring amino acid
  MOD_RES (460)..(460): Xaa can be any naturally occurring amino acid
  MOD_RES (493)..(493): Xaa can be any naturally occurring amino acid
  MOD_RES (562)..(562): Xaa can be any naturally occurring amino acid
  MOD_RES (576)..(576): Xaa can be any naturally occurring amino acid
  MOD_RES (587)..(587): Xaa can be any naturally occurring amino acid
  MOD_RES (609)..(609): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAXKRLNFGQTGDSESVPDPQPLGEPPAAPSGVGSNTMXAGGGAPMADNNEGADGVGNASGNWHCDSTWLGDRVITTSTRTWALPTYNNHLYKQISSQSGXSTNDNTYFGYSTPWGYFDFNRFHCHFSPRDWQRLINNNWGFRPKXLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFXFSYTFEDVPFHSSYAHSQSLDRLMNPLIDQYLYYLSRTQTTSGTAGNRXLQFSQAGPSSMANQAKNWLPGPCYRQQRVSKTXNQNNNSNFAWTGATKYHLNGRDSLVNPGPAMATHKDDEDKFFPMSGVLIFGKQGAGNSNVDLDNVMITXEEEIKTTNPVATEXYGTVATNLQSXNTAPATGTVNSQGALPGMVWQXRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 1844 - DNA, 2208 bp, Artificial Sequence
  Description of Artificial Sequence: Synthetic polynucleotide
  misc_feature (502)..(504): n is a, c, g, or t
  misc_feature (610)..(612): n is a, c, g, or t
  misc_feature (796)..(798): n is a, c, g, or t
  misc_feature (931)..(933): n is a, c, g, or t
  misc_feature (1231)..(1233): n is a, c, g, or t
  misc_feature (1378)..(1380): n is a, c, g, or t
  misc_feature (1477)..(1479): n is a, c, g, or t
  misc_feature (1684)..(1686): n is a, c, g, or t
  misc_feature (1726)..(1728): n is a, c, g, or t
  misc_feature (1759)..(1761): n is a, c, g, or t
  misc_feature (1825)..(1827): n is a, c, g, or t
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcaatcaccccaggaaccagactcctcttcgggcatcggcaagaaaggccagcagcccgcgnnnaagagactcaactttgggcagacaggcgactcagagtcagtgcccgaccctcaaccactcggagaaccccccgcagccccctctggtgtgggatctaatacaatgnnngcaggcggtggcgctccaatggcagacaataacgaaggcgccgacggagtgggtaacgcctcaggaaattggcattgcgattccacatggctgggcgacagagtcatcaccaccagcacccgaacctgggccctccccacctacaacaaccacctctacaagcaaatctccagccaatcgggannnagcaccaacgacaacacctacttcggctacagcaccccctgggggtattttgactttaacagattccactgccacttctcaccacgtgactggcagcgactcatcaacaacaactggggattccggcccaagnnnctcaacttcaagctcttcaacatccaggtcaaggaggtcacgacgaatgatggcaccacgaccatcgccaataaccttaccagcacggttcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttnnnttcagctacacgtttgaggacgtgccttttcacagcagctacgcgcacagccaaagcctggaccggctgatgaaccccctcatcgaccagtacctgtactacctgtctcggactcagaccacgagtggtaccgcaggaaatcggnnnttgcaattttctcaggccgggcctagtagcatggcgaatcaggccaaaaactggctacccgggccctgctaccggcagcaacgcgtctccaagacannnaatcaaaataacaacagcaactttgcctggaccggtgccaccaagtatcatctgaatggcagagactctctggtaaatcccggtcccgctatggcaacccacaaggacgacgaagacaaattttttccgatgagcggagtcttaatatttgggaaacagggagctggaaatagcaacgtggaccttgacaacgttatgataaccnnngaggaagaaattaaaaccaccaacccagtggccacagaannntacggcacggtggccactaacctgcaatcgnnnaacaccgctcctgctacagggaccgtcaacagtcaaggagccttacctggcatggtctggcagnnncgggacgtgtacctgcagggtcctatctgggccaagattcctcacacggacggacactttcatccctcgccgctgatgggaggctttggactgaaacacccgcctcctcagatcctgattaagaatacacctgttcccgcgaatcctccaactaccttcagtccagctaagtttgcgtcgttcatcacgcagtacagcaccggacaggtcagcgtggaaattgaatgggagctgcagaaagaaaacagcaaacgctggaacccagagattcaatacacttccaactacaacaaatctacaaatgtggactttgctgttgacacaaatggcgtttattctgagcctcgccccatcggcacccgttacctcacccgtaatctg

SEQ ID NO: 1845 - protein, 737 aa, Artificial Sequence
  Description of Artificial Sequence: Synthetic polypeptide
  MOD_RES (157)..(157): Xaa can be any naturally occurring amino acid
  MOD_RES (168)..(168): Xaa can be any naturally occurring amino acid
  MOD_RES (262)..(263): Xaa can be any naturally occurring amino acid
  MOD_RES (312)..(312): Xaa can be any naturally occurring amino acid
  MOD_RES (412)..(412): Xaa can be any naturally occurring amino acid
  MOD_RES (460)..(461): Xaa can be any naturally occurring amino acid
  MOD_RES (552)..(552): Xaa can be any naturally occurring amino acid
  MOD_RES (556)..(557): Xaa can be any naturally occurring amino acid
  MOD_RES (563)..(563): Xaa can be any naturally occurring amino acid
  MOD_RES (580)..(580): Xaa can be any naturally occurring amino acid
  MOD_RES (588)..(588): Xaa can be any naturally occurring amino acid
  MOD_RES (664)..(664): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSXGIGKKGQQPAXKRLNFGQTGDSESVPDPQPLGEPPAAPSGVGSNTMAAGGGAPMADNNEGADGVGNASGNWHCDSTWLGDRVITTSTRTWALPTYNNHLYKQISXXQSGGSTNDNTYFGYSTPWGYFDFNRFHCHFSPRDWQRLINNNWGFRPKXLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFXFSYTFEDVPFHSSYAHSQSLDRLMNPLIDQYLYYLSRTQTTGGTAGNXXLQFSQAGPSSMANQAKNWLPGPCYRQQRVSKTTNQNNNSNFAWTGATKYHLNGRDSLVNPGVAMATHKDDEDRFFPSSGVLIFGKQGAGNXNVDXXNVMITXEEEIKTTNPVATEEYGXVATNLQSXNTAPQTGTVNSQGALPGMVWQNRDVYLQGPIWAKIPHTDGNFHPSPLMGGFGLKHPPPQILIKNTPVPANPPTTFXPAKFASFITQYSTGQVSVEIEWELQKENSKRWNPEIQYTSNYNKSTNVDFAVDTEGVYSEPRPIGTRYLTRNL

SEQ ID NO: 1846 - DNA, 2211 bp, Artificial Sequence
  Description of Artificial Sequence: Synthetic polynucleotide
  misc_feature (469)..(471): n is a, c, g, or t
  misc_feature (502)..(504): n is a, c, g, or t
  misc_feature (784)..(789): n is a, c, g, or t
  misc_feature (934)..(936): n is a, c, g, or t
  misc_feature (1234)..(1236): n is a, c, g, or t
  misc_feature (1378)..(1383): n is a, c, g, or t
  misc_feature (1654)..(1656): n is a, c, g, or t
  misc_feature (1666)..(1671): n is a, c, g, or t
  misc_feature (1687)..(1689): n is a, c, g, or t
  misc_feature (1738)..(1740): n is a, c, g, or t
  misc_feature (1762)..(1764): n is a, c, g, or t
  misc_feature (1990)..(1992): n is a, c, g, or t
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcaatcaccccaggaaccagactcctctnnnggcatcggcaagaaaggccagcagcccgcgnnnaagagactcaactttgggcagactggcgactcagagtcagtgcccgaccctcaaccactcggagaaccccccgcagccccctctggtgtgggatctaatacaatggctgcaggcggtggcgctccaatggcagacaataacgaaggcgccgacggagtgggtaatgcctcaggaaattggcattgcgattccacatggctgggcgacagagtcatcaccaccagcacccgaacctgggccctccccacctacaacaaccacctctacaagcaaatctccnnnnnncaatcgggaggaagcaccaacgacaacacctacttcggctacagcaccccctgggggtattttgactttaacagattccactgccacttctcaccacgtgactggcagcgactcatcaacaacaactggggattccggcccaagnnnctcaacttcaagctcttcaacatccaggtcaaggaggtcacgacgaatgatggcaccacgaccatcgccaataaccttaccagcacggttcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttnnnttcagctacacgtttgaggacgtgccttttcacagcagctacgcgcacagccaaagcctggaccggctgatgaaccccctcatcgaccagtacctgtactacctgtctcggactcagaccacgggaggtaccgcaggaaatnnnnnnttgcaattttctcaggccgggcctagtagcatggcgaatcaggccaaaaactggctacccgggccctgctaccggcagcaacgcgtctccaagacaacgaatcaaaataacaacagcaactttgcctggaccggtgccaccaagtatcatctgaatggcagagactctctggtaaatcccggtgtcgctatggcaacccacaaggacgacgaagaccgattttttccgtccagcggagtcttaatatttgggaaacagggagctggaaatnnnaacgtggacnnnnnnaacgttatgataaccnnngaggaagaaattaaaaccaccaacccagtggccacagaagagtacggcnnngtggccactaacctgcaatcgnnnaacaccgctcctcaaacagggaccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcgaatcctccaactaccttcnnnccagctaagtttgcgtcgttcatcacgcagtacagcaccggacaggtcagcgtggaaattgaatgggagctgcagaaagaaaacagcaaacgctggaacccagagattcaatacacttccaactacaacaaatctacaaatgtggactttgctgttgacacagaaggcgtttattctgagcctcgccccatcggcacccgttacctcacccgtaatctg

SEQ ID NO: 1847 - protein, 738 aa, Artificial Sequence
  Description of Artificial Sequence: Synthetic polypeptide
  MOD_RES (158)..(158): Xaa can be any naturally occurring amino acid
  MOD_RES (169)..(169): Xaa can be any naturally occurring amino acid
  MOD_RES (564)..(564): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQREPDSSXGIGKKGQQPAXKRLNFGQTGDSESVPDPQPLGEPPAAPSGVGSNTMAAGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTGGTAGTQTLQFSQAGPSSMANQAKNWLPGPCYRQQRVSTTTNQNNNSNFAWTGATKYHLNGRDSLVNPGVAMATHKDDEDRFFPSSGVLIFGKQGAGNDNVDYSNVMITXEEEIKTTNPVATEEYGVVATNLQSANTAPQTGTVNSQGALPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 1848 - DNA, 2214 bp, Artificial Sequence
  Description of Artificial Sequence: Synthetic polynucleotide
  misc_feature (472)..(474): n is a, c, g, or t
  misc_feature (505)..(507): n is a, c, g, or t
  misc_feature (1690)..(1692): n is a, c, g, or t
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcaccacagcgtgagcccgactcctccnnnggcatcggcaagaaaggccagcagcccgccnnnaagagactcaatttcggtcagactggcgactcagagtcagtccccgaccctcaacctctcggagaacctccagcagcgccctctggtgtgggatctaatacaatggctgcaggcggtggcgcaccaatggcagacaataacgaaggtgccgacggagtgggtaattcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcaacttcaagctcttcaacatccaggtcaaagaggtcacgacgaatgaaggcaccaagaccatcgccaataacctcaccagcaccgtccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaactttcaattcagctacactttcgaggacgtgcctttccacagcagctacgcgcacagccagagtttggacaggctgatgaatcctctcatcgaccagtacctgtactacctgtcaagaacccagactacgggaggcacagcgggaacccagacgttgcagttttctcaggccgggcctagcagcatggcgaatcaggccaaaaactggctgcctggaccctgctacagacagcagcgcgtctccacgacaacgaatcaaaacaacaacagcaactttgcctggactggtgccaccaagtatcatctgaacggcagagactctctggtgaatccgggcgtcgccatggcaacccacaaggacgacgaggaccgcttcttcccatccagcggcgtcctcatatttggcaagcagggagctggaaatgacaacgtggactatagcaacgtgatgataaccnnngaggaagaaatcaagaccaccaaccccgtggccacagaagagtatggcgtggtggctactaacctacagtcggcaaacaccgctcctcaaacggggaccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacaacgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctg

SEQ ID NO: 1849 - protein, 738 aa, Artificial Sequence
  Description of Artificial Sequence: Synthetic polypeptide
  MOD_RES (158)..(158): Xaa can be any naturally occurring amino acid
  MOD_RES (169)..(169): Xaa can be any naturally occurring amino acid
  MOD_RES (315)..(315): Xaa can be any naturally occurring amino acid
  MOD_RES (413)..(413): Xaa can be any naturally occurring amino acid
  MOD_RES (472)..(472): Xaa can be any naturally occurring amino acid
  MOD_RES (534)..(534): Xaa can be any naturally occurring amino acid
  MOD_RES (542)..(542): Xaa can be any naturally occurring amino acid
  MOD_RES (595)..(595): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQREPDSSXGIGKKGQQPAXKRLNFGQTGDSESVPDPQPLGEPPAAPSGVGSNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLXFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFXFSYTFEDVPFHSSYAHSQSLDRLMNPLIDQYLYYLSRTQTTGGTAGTQTLQFSQAGPSXMANQAKNWLPGPCYRQQRVSTTTSQNNNSNFAWTGATKYHLNGRDSLVNPGVAMATHKDDEXRFFPSSGXLIFGKQGAGKDNVDYSNVMLTSEEEIKTTNPVATEEYGVVADNLQQQNTAPQXGTVNSQGALPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 1850 - DNA, 2214 bp, Artificial Sequence
  Description of Artificial Sequence: Synthetic polynucleotide
  misc_feature (472)..(474): n is a, c, g, or t
  misc_feature (505)..(507): n is a, c, g, or t
  misc_feature (943)..(945): n is a, c, g, or t
  misc_feature (1237)..(1239): n is a, c, g, or t
  misc_feature (1414)..(1416): n is a, c, g, or t
  misc_feature (1600)..(1602): n is a, c, g, or t
  misc_feature (1624)..(1626): n is a, c, g, or t
  misc_feature (1783)..(1785): n is a, c, g, or t
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcaccacagcgtgagcccgactcctccnnnggcatcggcaagaaaggccagcagcccgccnnnaagagactcaatttcggtcagactggcgactcagagtcagtccccgaccctcaacctctcggagaacctccagcagcgccctctggtgtgggatctaatacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcnnnttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaactttnnnttcagctacactttcgaggacgtgcctttccacagcagctacgcgcacagccagagtttggacaggctgatgaatcctctcatcgaccagtacctgtactacctgtcaagaacccagactacgggaggcacagcgggaacccagacgttgcagttttctcaggccgggcctagcnnnatggcgaatcaggccaaaaactggctgcctggaccctgctacagacagcagcgcgtctccacgacaacgtcgcaaaacaacaacagcaactttgcctggactggtgccaccaagtatcatctgaacggcagagactctctggtgaatccgggcgtcgccatggcaacccacaaggacgacgagnnncgcttcttcccatccagcggcnnnctcatatttggcaagcagggagctggaaaagacaacgtggactatagcaacgtgatgctaaccagcgaggaagaaatcaagaccaccaaccccgtggccacagaagagtatggcgtggtggctgataacctacagcagcaaaacaccgctcctcaannngggaccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacaacgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctg

SEQ ID NO: 1851 - protein, 738 aa, Artificial Sequence
  Description of Artificial Sequence: Synthetic polypeptide
  MOD_RES (169)..(169): Xaa can be any naturally occurring amino acid
  MOD_RES (315)..(315): Xaa can be any naturally occurring amino acid
  MOD_RES (534)..(534): Xaa can be any naturally occurring amino acid
  MOD_RES (542)..(542): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAXKRLNFGQTGDSESVPDPQPIGEPPAAPSGVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLXFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTAGTQQLLFSQAGPSNMSAQAKNWLPGPCYRQQRVSTTLSQNNNSNFAWTGATKYHLNGRDSLVNPGVAMATHKDDEXRFFPSSGXLMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 1852 - DNA, 2214 bp, Artificial Sequence
  Description of Artificial Sequence: Synthetic polynucleotide
  misc_feature (505)..(507): n is a, c, g, or t
  misc_feature (943)..(945): n is a, c, g, or t
  misc_feature (1600)..(1602): n is a, c, g, or t
  misc_feature (1624)..(1626): n is a, c, g, or t
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccnnnaagagactcaatttcggtcagactggcgactcagagtcagtccccgaccctcaacctatcggagaacctccagcagcgccctctggtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcnnnttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaactttgagttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccaaaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaacccacaaggacgacgagnnncgcttcttcccatccagcggcnnnctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacaacgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctg

SEQ ID NO: 1853 - protein, 738 aa, Artificial Sequence
  Description of Artificial Sequence: Synthetic polypeptide
  MOD_RES (471)..(471): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTAGTQQLLFSQAGPXNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 1854 - DNA, 2214 bp, Artificial Sequence
  Description of Artificial Sequence: Synthetic polynucleotide
  misc_feature (1411)..(1413): n is a, c, g, or t
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctacacgtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctnnnaacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacaccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagaaggcacttattctgagcctcgccccatcggcacccgttacctcacccgtaatctg

SEQ ID NO: 1855 - protein, 737 aa, Artificial Sequence
  Description of Artificial Sequence: Synthetic polypeptide
  MOD_RES (148)..(148): Xaa can be any naturally occurring amino acid
  MOD_RES (169)..(169): Xaa can be any naturally occurring amino acid
  MOD_RES (314)..(314): Xaa can be any naturally occurring amino acid
  MOD_RES (466)..(466): Xaa can be any naturally occurring amino acid
  MOD_RES (563)..(563): Xaa can be any naturally occurring amino acid
  MOD_RES (580)..(580): Xaa can be any naturally occurring amino acid
  MOD_RES (588)..(588): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEXSPQRSPDSSTGIGKKGQQPAXKRLNFGQTGDSESVPDPQPLGEPPAAPSGVGSGTMAAGGGAPMADNNEGADGVGNASGNWHCDSTWLGDRVITTSTRTWALPTYNNHLYKQISSQSAGSTNDNTYFGYSTPWGYFDFNRFHCHFSPRDWQRLINNNWGFRPKKLXFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYTFEDVPFHSSYAHSQSLDRLMNPLIDQYLYYLARTQSTTGGTAGNRELQFXQAGPSTMAEQAKNWLPGPCYRQQRVSKTLDQNNNSNFAWTGATKYHLNGRNSLVNPGVAMATHKDDEDRFFPSSGVLIFGKTGAANKTTLENVLMTXEEEIKTTNPVATEEYGXVSSNLQSXNTAPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYDKSTNVDFAVDSEGVYSEPRPIGTRYLTRNL

SEQ ID NO: 1856 - DNA, 2211 bp, Artificial Sequence
  Description of Artificial Sequence: Synthetic polynucleotide
  misc_feature (442)..(444): n is a, c, g, or t
  misc_feature (505)..(507): n is a, c, g, or t
  misc_feature (940)..(942): n is a, c, g, or t
  misc_feature (1396)..(1398): n is a, c, g, or t
  misc_feature (1687)..(1689): n is a, c, g, or t
  misc_feature (1738)..(1740): n is a, c, g, or t
  misc_feature (1762)..(1764): n is a, c, g, or t
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctggaaagaagagaccggtagagnnntcacctcagcgttcccccgactcctccacgggcatcggcaagaaaggccagcagcccgccnnnaagagactcaatttcggtcagactggcgactcagagtcagtccccgaccctcaacctctcggagaacctccagcagcgccctctggtgtgggatctggtacaatggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtcaaagtgcaggtagtaccaacgacaacacctacttcggctacagcaccccctgggggtattttgactttaacagattccactgccacttctcaccacgtgactggcagcgactcatcaacaacaactggggattccggcccaagaagctgnnnttcaagctcttcaacatccaggtcaaggaggtcacgacgaatgacggcgttacgaccatcgctaataaccttaccagcacggttcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacaccttcgaggacgtgcctttccacagcagctacgcacacagccagagcctggaccggctgatgaatcccctcatcgaccagtacttgtactacctggccagaacacagagtaccacaggaggcacagctggcaatcgggaactgcagtttnnncaggccgggccttcaactatggccgaacaagccaagaattggttacctggaccttgctaccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcagctaacaaaactacattggaaaatgtgttaatgacannngaagaagaaattaaaactactaatcctgtagccacggaagaatacgggnnngtcagcagcaacttacaatcgnnnaatactgcaccccagacacaaactgtcaacagccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactatgataagtcgactaatgtggactttgccgttgacagcgagggtgtttactctgagcctcgccctattggcactcgttacctcacccgtaatctg

SEQ ID NO: 1857 - protein, 735 aa, Artificial Sequence
  Description of Artificial Sequence: Synthetic polypeptide
  MOD_RES (162)..(162): Xaa can be any naturally occurring amino acid
  MOD_RES (168)..(168): Xaa can be any naturally occurring amino acid
  MOD_RES (224)..(224): Xaa can be any naturally occurring amino acid
  MOD_RES (310)..(310): Xaa can be any naturally occurring amino acid
  MOD_RES (410)..(410): Xaa can be any naturally occurring amino acid
  MOD_RES (446)..(446): Xaa can be any naturally occurring amino acid
  MOD_RES (461)..(461): Xaa can be any naturally occurring amino acid
  MOD_RES (471)..(471): Xaa can be any naturally occurring amino acid
  MOD_RES (708)..(708): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKXGQQPAXKRLNFGQTGDSESVPDPQPLGEPPAAPSGVGSNTMASGGGAPMADNNEGADGVGNXSGNWHCDSTWLGDRVITTSTRTWALPTYNNHLYKQISSQSGASNDNHYFGYSTPWGYFDFNRFHCHFSPRDWQRLINNNWGFRPKXLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFXFSYTFEDVPFHSSYAHSQSLDRLMNPLIDQYLYYLXRTQTTSGTAQNRELXFSQAGPSSMXNQAKNWLPGPCYRQQRVSKTANDNNNSNFAWTGATKYHLNGRDSLVNPGPAMASHKDDEDKFFPMSGVLIFGKQGAGASNVDLDNVMITDEEEIKTTNPVATEQYGTVATNLQSSNTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSXNVDFTVDTNGVYSEPRPIGTRYLTRNL

SEQ ID NO: 1858 - DNA, 2205 bp, Artificial Sequence
  Description of Artificial Sequence: Synthetic polynucleotide
  misc_feature (484)..(486): n is a, c, g, or t
  misc_feature (502)..(504): n is a, c, g, or t
  misc_feature (670)..(672): n is a, c, g, or t
  misc_feature (928)..(930): n is a, c, g, or t
  misc_feature (1228)..(1230): n is a, c, g, or t
  misc_feature (1336)..(1338): n is a, c, g, or t
  misc_feature (1381)..(1383): n is a, c, g, or t
  misc_feature (1411)..(1413): n is a, c, g, or t
  misc_feature (2122)..(2124): n is a, c, g, or t
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctcttggtctggttgaggaaggtgctaagacggctcctggaaagaaacgtccggtagagcagtcgccacaagagccagactcctcctcgggcattggcaagnnnggccagcagcccgctnnnaagagactcaattttggtcagactggcgactcagagtcagtccccgacccacaacctctcggagaacctccagcagccccctctggtgtgggatctaatacaatggcttcaggcggtggcgcaccaatggcagacaataacgaaggcgccgacggagtgggtaatnnntcaggaaattggcattgcgattccacatggctgggcgacagagtcatcaccaccagcacccgaacatgggccttgcccacctataacaaccacctctacaagcaaatctccagtcaatcaggggccagcaacgacaaccactacttcggctacagcaccccctgggggtattttgatttcaacagattccactgccatttctcaccacgtgactggcagcgactcatcaacaacaattggggattccggcccaagnnnctcaacttcaagctcttcaacatccaagtcaaggaggtcacgacgaatgatggcaccacgaccatcgctaataaccttaccagcacggttcaagtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttnnnttcagctacaccttcgaggacgtgcctttccacagcagctacgcgcacagccagagcctggaccggctgatgaatcctctcatcgaccagtacctgtattacctgnnnagaactcagactacgtccggaactgcccaaaacagggagttgnnntttagccaggcgggtccatctagcatgnnnaatcaggccaaaaactggctacctggaccctgttaccggcagcagcgcgtttctaaaacagcaaatgacaacaacaacagcaactttgcctggactggtgctacaaaatatcaccttaatgggcgtgattctttagtcaaccctggccctgctatggcctcacacaaagacgacgaagacaagttctttcccatgagcggtgtcttgatttttggaaagcagggcgccggagcttcaaacgttgatttggacaatgtcatgatcacagacgaagaggaaatcaaaaccactaaccccgtggccaccgaacaatatgggactgtggcaaccaatctccagagcagcaacacagcccctgcgaccggaactgtgaattctcagggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccgacaacgttttcgcctgcaaagtttgcttcattcatcacccagtattccacaggacaagtgagcgtggagattgaatgggagctgcagaaagaaaacagcaaacgctggaatcccgaaatacagtatacatctaactataataaatctnnnaacgttgatttcactgtggacaccaatggagtttatagtgagcctcgccccattggcacccgttacctcacccgtaacctg

SEQ ID NO: 1859 - protein, 735 aa, Artificial Sequence
  Description of Artificial Sequence: Synthetic polypeptide
  MOD_RES (42)..(42): Xaa can be any naturally occurring amino acid
  MOD_RES (168)..(168): Xaa can be any naturally occurring amino acid
  MOD_RES (310)..(310): Xaa can be any naturally occurring amino acid
  MOD_RES (410)..(410): Xaa can be any naturally occurring amino acid
  MOD_RES (446)..(446): Xaa can be any naturally occurring amino acid
  MOD_RES (461)..(461): Xaa can be any naturally occurring amino acid
  MOD_RES (471)..(471): Xaa can be any naturally occurring amino acid
  MOD_RES (475)..(475): Xaa can be any naturally occurring amino acid
  MOD_RES (504)..(504): Xaa can be any naturally occurring amino acid
  MOD_RES (539)..(539): Xaa can be any naturally occurring amino acid
MAADGYLPDWLEDNLSEGIREWWDLKPGAPQPKANQQHQDDXRGLVLPGYKYLGPFNGLDKGEPVNEADAAALEHDKAYDQQLKAGDNPYLKYNHADAEFQERLQEDTSFGGNLGRAVFQAKKRVLEPLGLVEEAAKTAPGKKRPVEQSPQEPDSSSGIGKSGQQPAXKRLNFGQTGDSESVPDPQPLGEPPAAPSGVGSNTMASGGGAPMADNNEGADGVGNSSGNWHCDSTWLGDRVITTSTRTWALPTYNNHLYKQISSQSGASNDNHYFGYSTPWGYFDFNRFHCHFSPRDWQRLINNNWGFRPKXLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFXFSYTFEDVPFHSSYAHSQSLDRLMNPLIDQYLYYLXRTQTTSGTTQQSRLXFSQAGPSSMXQQAXNWLPGPCYRQQRVSKTANDNNNSNFAWTXATKYHLNGRDSLVNPGPAMASHKDDEEKFFPMHGXLIFGKQGTGASNVDLDNVMITDEEEIRTTNPVATEQYGTVATNLQSSNTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 1860 - DNA, 2205 bp, Artificial Sequence
  Description of Artificial Sequence: Synthetic polynucleotide
  misc_feature (124)..(126): n is a, c, g, or t
  misc_feature (502)..(504): n is a, c, g, or t
  misc_feature (928)..(930): n is a, c, g, or t
  misc_feature (1228)..(1230): n is a, c, g, or t
  misc_feature (1336)..(1338): n is a, c, g, or t
  misc_feature (1381)..(1383): n is a, c, g, or t
  misc_feature (1411)..(1413): n is a, c, g, or t
  misc_feature (1423)..(1425): n is a, c, g, or t
  misc_feature (1510)..(1512): n is a, c, g, or t
  misc_feature (1615)..(1617): n is a, c, g, or t
atggctgctgacggttatcttccagattggctcgaggacaacctttctgaaggcattcgtgagtggtgggatctgaaacctggagcccctcaacccaaagcgaaccaacaacaccaggacgacnnncggggtcttgtgcttccgggttacaaatacctcggaccctttaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagagggtccttgagcctcttggtctggttgaggaagcagctaaaacggctcctggaaagaagaggcctgtagaacagtctcctcaggaaccggactcatcatctggtattggcaaatcgggccaacagcctgccnnnaaaagactaaatttcggtcagactggagactcagagtcagtcccagaccctcaacctctcggagaaccaccagcagccccctcaggtgtgggatctaatacaatggcttcaggcggtggcgcaccaatggcagacaataacgagggtgccgatggagtgggtaattcctcaggaaattggcattgcgattccacatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagnnnctcaacttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatgatccctcagtatggatacctcaccctgaacaacggaagtcaagcggtgggacgctcatccttttactgcctggagtacttcccttcgcagatgctaaggactggaaataacttcnnnttcagctataccttcgaggatgtaccttttcacagcagctacgctcacagccagagtttggatcgcttgatgaatcctcttattgatcagtatctgtactacctgnnnagaacgcaaacaacctctggaacaacccaacaatcacggctgnnntttagccaggctgggccttcgtctatgnnncagcaggccnnnaattggctacctgggccctgctaccggcaacagagagtttcaaagactgctaacgacaacaacaacagtaactttgcttggacannngccaccaaatatcatctcaatggccgcgactcgctggtgaatccaggaccagctatggccagtcacaaggacgatgaagaaaaatttttccctatgcacggcnnnctaatatttggcaaacaagggacaggggcaagtaacgtagatttagataatgtaatgattacggatgaagaagagattcgtaccaccaatcctgtggcaacagagcagtatggaactgtggcaactaacttgcagagctcaaatacagctcccgcgactggaactgtcaatagtcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcttgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttg

SEQ ID NO: 1861 - protein, 736 aa, Artificial Sequence; identical to SEQ ID NO: 1569
  Description of Artificial Sequence: Synthetic polypeptide

SEQ ID NO: 1862 - protein, 736 aa, Artificial Sequence; identical to SEQ ID NO: 1570
  Description of Artificial Sequence: Synthetic polypeptide

SEQ ID NO: 1863 - protein, 736 aa, Artificial Sequence; identical to SEQ ID NO: 1571
  Description of Artificial Sequence: Synthetic polypeptide

SEQ ID NO: 1864 - protein, 736 aa, Artificial Sequence; identical to SEQ ID NO: 1572
  Description of Artificial Sequence: Synthetic polypeptide

SEQ ID NO: 1865 - protein, 736 aa, Artificial Sequence; identical to SEQ ID NO: 1573
  Description of Artificial Sequence: Synthetic polypeptide

SEQ ID NO: 1866 - protein, 736 aa, Artificial Sequence; identical to SEQ ID NO: 1574
  Description of Artificial Sequence: Synthetic polypeptide

SEQ ID NO: 1867 - protein, 736 aa, Artificial Sequence; identical to SEQ ID NO: 1575
  Description of Artificial Sequence: Synthetic polypeptide

SEQ ID NO: 1868 - protein, 736 aa, Artificial Sequence; identical to SEQ ID NO: 1576
  Description of Artificial Sequence: Synthetic polypeptide

SEQ ID NO: 1869 - DNA, 2211 bp, Artificial Sequence; identical to SEQ ID NO: 1577
  Description of Artificial Sequence: Synthetic polynucleotide

SEQ ID NO: 1870 - protein, 738 aa, Artificial Sequence; identical to SEQ ID NO: 7
  Description of Artificial Sequence: Synthetic polypeptide

SEQ ID NO: 1871 - protein, 738 aa, Artificial Sequence; identical to SEQ ID NO: 7
  Description of Artificial Sequence: Synthetic polypeptide

SEQ ID NO: 1872 - protein, 738 aa, Artificial Sequence
  Description of Artificial Sequence: Synthetic polypeptide
  MOD_RES (157)..(157): Xaa can be any naturally occurring amino acid
  MOD_RES (169)..(169): Xaa can be any naturally occurring amino acid
  MOD_RES (457)..(457): Xaa can be any naturally occurring amino acid
  MOD_RES (463)..(463): Xaa can be any naturally occurring amino acid
  MOD_RES (508)..(508): Xaa can be any naturally occurring amino acid
  MOD_RES (510)..(511): Xaa can be any naturally occurring amino acid
  MOD_RES (558)..(558): Xaa can be any naturally occurring amino acid
  MOD_RES (585)..(585): Xaa can be any naturally occurring amino acid
  MOD_RES (587)..(587): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSXLGIGKTGQQPAXKRLNFGQTGDSESVPDPQPLGEPPAAPSGVGSNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTGTXGTQTLXFSQAGPSSMANQARNWVPGPCYRQQRVSTTTNQNNNSNFAWTGAXKXXLNGRDSLMNPGVAMASHKDDEDRFFPSSGVLIFGKQGAGNDNVDYSXVMITNEEEIKTTNPVATEEYGAVATNXQXLANTQAQTGLVHNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 1873 - DNA, 2211 bp, Artificial Sequence
  Description of Artificial Sequence: Synthetic polynucleotide
  misc_feature (469)..(471): n is a, c, g, or t
  misc_feature (502)..(504): n is a, c, g, or t
  misc_feature (1366)..(1368): n is a, c, g, or t
  misc_feature (1384)..(1386): n is a, c, g, or t
  misc_feature (1519)..(1521): n is a, c, g, or t
  misc_feature (1525)..(1530): n is a, c, g, or t
  misc_feature (1669)..(1671): n is a, c, g, or t
  misc_feature (1750)..(1752): n is a, c, g, or t
  misc_feature (1756)..(1758): n is a, c, g, or t
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagaggccggtagagcagtcgccacaagagccagactcctccnnnggcatcggcaagacaggccagcagcccgctnnnaagagactcaattttggtcagactggcgactcagagtcagtccccgacccacaacctctcggagaacctccagcagccccctcaggtgtgggatctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatgattcctcagtacggctatttaactttaaacaatggaagccaagccgtgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctgtccagaacgcaaacgactggaactnnngggacgcagactctgnnnttcagccaagcgggtcctagctcaatggccaaccaggctagaaattgggtgcccggaccttgctaccggcagcagcgcgtctccacgacaaccaaccagaacaacaacagcaactttgcctggacgggagctnnnaagnnnnnnctgaacggccgagactctctaatgaatccgggcgtggcaatggcttcccacaaggatgacgaggaccgcttcttcccttcgagcggggtcctgatttttggcaagcaaggagccgggaacgataatgtggattacagcnnngtgatgattacaaatgaggaagaaatcaagactaccaaccccgtggccacagaagaatatggagcagtggccaccaacnnncagnnngccaatacgcaggcgcagaccggactcgtgcacaaccagggggtgcttcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgactaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaa

SEQ ID NO: 1874 - protein, 733 aa, Artificial Sequence; identical to SEQ ID NO: 423
  Description of Artificial Sequence: Synthetic polypeptide

SEQ ID NO: 1875 - DNA, 4472 bp, Artificial Sequence
  Description of Artificial Sequence: Synthetic polynucleotide
ctccatcactaggggtaaccgcgaagcgcctcccacgctgccgcgtcagcgctgacgtaaattacgtcataggggagtggtcctgtattagctgtcacgtgagtgcttttgcgacattttgcgacaccacgtggccattcatggtatatatggccgagtgagcgagcaggatctccattttgaccgcgaaatttgaacgagcagcagccatgccgggcttctacgagatcgtgcttaaggtgccgagcgacctggacgagcacctgccgggcatttctgactcgtttgtgaactgggtggcagagaaggaatgggagctgcccccggattctgacatggatcggaatctgattgagcaggcacccctgaccgtggccgagaagctacagcgcgacttcctggtccaatggcgccgcgtgagtaaggccccggaggccctcttctttgttcagttcgagaagggcgagtcctacttccacctccatattctggtagagaccacgggggtcaaatccatggtgctgggccgcttcctgagtcagattcgggacaagctggtgcagaccatctaccgcgggatcgagccgaccctgcccaactggttcgcggtgacaaagacgcgtaatggcgccggaggggggaacaaggtggtggacgagtgctacatccccaactacctgctgcccaagactcagcccgagctgcagtgggcgtggactaacatggaggagtatataagcgcgtgcttgaacctggccgagcgcaaacggctcgtggcgcagcacctgacccacgtcagccagacccaggagcagaacaaggagaatctgaacccgaattctgacgcgcctgtcatccggtcaaaaacctccgcgcgctacatggagctggtcgggtggctggtggaccggggcatcacctccgagaagcagtggatccaggaggaccaggcctcgtacatctccttcaacgccgcctccaactcgcggtctcagatcaaggccgcgctggacaatgccggcaagatcatggcgctgaccaaatccgcgcccgactacctggtaggccccgctctgcccgcggacattaaatccaaccgcatctaccgcatcctggagctgaatggctacgaccctgcctacgccggttccgtctttctcggctgggcccagaaaaagtttggcaaaaggaacaccatctggctgtttgggccggccaccacgggcaagaccaacatcgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacctccaacaccaacatgtgcgccgtgattgacgggaacagcaccaccttcgagcaccagcagccgttgcaggaccggatgttcaaatttgaacttacccgccgtctggagcacgactttggcaaggtgacaaagcaggaagtcaaagagttcttccgctgggcgcaggatcacgtgaccgaggtggcgcatgagttctacgtcagaaagggtggagctaacaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccctggcgtgtcagaatctcaaccggtcgtcagaaaaaagacgtatcggaaactctgtgcgattcatcatctgctggggcgggcacccgagattgcttgctcggcctgcgacctggtcaacgtggacctggatgactgtgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctccaagcgggtgacaatccgtacctgcggtataatcacgccgacgccgagtttcaggagcgtctgcaagaagatacgtcttttgggggcaacctcgggcgcgcagtcttccaggccaaaaagcgggttctcgaacctctgggcctggttgaatcgccggttaagacggctcctggaaagaagagaccggtagagccatcaccccagcgctctccagactcctctacgggcatcggcaagaaaggccagcagcccgcaaaaaagagactcaattttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgcacctgggccctgcccacctacaacaaccacctctacaagcaaatctccaacgggacctcgggaggaagcaccaacgacaacacctacttcggctacagcaccccctgggggtattttgacttcaacagattccactgccacttttcaccacgtgactggcagcgactcatcaacaacaactggggattccggcccaagaggctcaacttcaagctcttcaacatccaagtcaaggaggtcacgcagaatgaaggcaccaagaccatcgccaataaccttaccagcacgattcaggtctttacggactcggaataccagctcccgtacgtgctcggctcggcgcaccagggctgcctgcctccgttcccggcggacgtcttcatgattcctcagtacgggtacctgactctgaacaatggcagtcaggctgtgggccggtcgtccttctactgcctggagtactttccttctcaaatgctgagaacgggcaacaactttgaattcagctacaacttcgaggacgtgcccttccacagcagctacgcgcacagccagagcctggaccggctgatgaaccctctcatcgaccagtacttgtactacctgtcccggactcaaagcacgggcggtactgcaggaactcagcagttgctattttctcaggccgggcctaacaacatgtcggctcaggccaagaactggctacccggtccctgctaccggcagcaacgcgtctccacgacactgtcgcagaacaacaacagcaactttgcctggacgggtgccaccaagtatcatctgaatggcagagactctctggtgaatcctggcgttgccatggctacccacaaggacgacgaagagcgattttttccatccagcggagtcttaatgtttgggaaacagggagctggaaaagacaacgtggactatagcagcgtgatgctaaccagcgaggaagaaataaagaccaccaacccagtggccacagaacagtacggcgtggtggccgataacctgcaacagcaaaacgccgctcctattgtaggggccgtcaatagtcaaggagccttacctggcatggtgtggcagaaccgggacgtgtacctgcagggtcccatctgggccaagattcctcatacggacggcaactttcatccctcgccgctgatgggaggctttggactgaagcatccgcctcctcagatcctgattaaaaacacacctgttcccgcggatcctccgaccaccttcactaaggccaagctggcttctttcatcacgcagtacagtaccggccaggtcagcgtggagatcgagtgggagctgcagaaggagaacagcaaacgctggaacccagagattcagtacacttccaactactacaaatctacaaatgtggactttgctgtcaatactgagggtacttattccgagcctcgccccattggcacccgttacctcacccgtaatctgtaattacatgttaatcaataaaccggttaattcgtttcagttgaactttggtctcctgtccttcttatcttatcggttaccatagaaactggttacttattaactgcttggtgcgcttcgcgataaaagacttacgtcatcgggttacccctagtgatgga

SEQ ID NO: 1876 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagaaggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaataccatggctacaggcagtggcgcaccaatggcagacaataacgagggtgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggctatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtgcctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 1877 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKKAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 1878 - DNA, 8376 bp, Artificial Sequence
  Description of Artificial Sequence: Synthetic polynucleotide
aattcccatcatcaataatataccttattttggattgaagccaatatgataatgagggggtggagtttgtgacgtggcgcggggcgtgggaacggggcgggtgacgtagtagtctctagagtcctgtattagaggtcacgtgagtgttttgcgacattttgcgacaccatgtggtcacgctgggtatttaagcccgagtgagcacgcagggtctccattttgaagcgggaggtttgaacgcgcagccaccacgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatgctctagagtcctgtattagaggtcacgtgagtgttttgcgacattttgcgacaccatgtggtcacgctgggtatttaagcccgagtgagcacgcagggtctccattttgaagcgggaggtttgaacgcgcagccaccacggcggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcatcgctggcgtaatagcgaagaggcccgcaccgatcgcccttcccaacagttgcgcagcctgaatggcgaatggaattccagacgattgagcgtcaaaatgtaggtatttccatgagcgtttttcctgttgcaatggctggcggtaatattgttctggatattaccagcaaggccgatagtttgagttcttctactcaggcaagtgatgttattactaatcaaagaagtattgcgacaacggttaatttgcgtgatggacagactcttttactcggtggcctcactgattataaaaacacttctcaggattctggcgtaccgttcctgtctaaaatccctttaatcggcctcctgtttagctcccgctctgattctaacgaggaaagcacgttatacgtgctcgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttaaatatttgcttatacaatcttcctgtttttggggcttttctgattatcaaccggggtacatatgattgacatgctagttttacgattaccgttcatcgattctcttgtttgctccagactctcaggcaatgacctgatagcctttgtagagacctctcaaaaatagctaccctctccggcatgaatttatcagctagaacggttgaatatcatattgatggtgatttgactgtctccggcctttctcacccgtttgaatctttacctacacattactcaggcattgcatttaaaatatatgagggttctaaaaatttttatccttgcgttgaaataaaggcttctcccgcaaaagtattacagggtcataatgtttttggtacaaccgatttagctttatgctctgaggctttattgcttaattttgctaattctttgccttgcctgtatgatttattggatgttggaattcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgca

SEQ ID NO: 1879 - DNA, 1085 bp, Artificial Sequence
  Description of Artificial Sequence: Synthetic polynucleotide
  misc_feature (611)..(611): n is a, c, g, or t
  misc_feature (640)..(640): n is a, c, g, or t
  misc_feature (1039)..(1039): n is a, c, g, or t
tgcccacttacaacaaccatctctacaagcaaatctccagcvvmdcaggagctascaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaargcamcvcnrgcggaacarccrvcmhsmrsvvsctgvngtttagccaggctgggcctcagtctatgtctttgcaggccagaaattggctacctgggccctgctaccggcaacagagactttcaamarycbmcrvcsrsaacaacaacagtrastttccttggmcagcggccagcamatatcatctcaatggccgcgactcgctggtgaatccaggaccagctatggccagtcacrrggacgatrmsgrsaratttttccctatgcacggcaatctaatatttggcaaasaarrcrscrvsrvarvcratrycgmsdwcgrsvrsgtaatgattacggatgaagaagagattcgtaccaccaatcctgtggcaacagagcagtatggaactgtggcaaataacttgcagrvsvvsmrsrvcvvscccacgdhtvvsrnsgtcvmscatcagggggccttacctggcatggtgtggcaagatcgt

SEQ ID NO: 1880 - protein, 620 aa, Artificial Sequence
  Description of Artificial Sequence: Synthetic polypeptide
  MOD_RES (263)..(264): Xaa can be any naturally occurring amino acid
  MOD_RES (267)..(267): Xaa can be any naturally occurring amino acid
  MOD_RES (450)..(453): Xaa can be any naturally occurring amino acid
  MOD_RES (456)..(460): Xaa can be any naturally occurring amino acid
  MOD_RES (462)..(462): Xaa can be any naturally occurring amino acid
  MOD_RES (491)..(495): Xaa can be any naturally occurring amino acid
  MOD_RES (500)..(500): Xaa can be any naturally occurring amino acid
  MOD_RES (504)..(504): Xaa can be any naturally occurring amino acid
  MOD_RES (508)..(508): Xaa can be any naturally occurring amino acid
  MOD_RES (528)..(528): Xaa can be any naturally occurring amino acid
  MOD_RES (531)..(533): Xaa can be any naturally occurring amino acid
  MOD_RES (546)..(557): Xaa can be any naturally occurring amino acid
  MOD_RES (586)..(590): Xaa can be any naturally occurring amino acid
  MOD_RES (593)..(595): Xaa can be any naturally occurring amino acid
  MOD_RES (597)..(597): Xaa can be any naturally occurring amino acid
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKGAVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSXXGAXNDNHYFGYSTPWGYFDFNRFHCHFSPRDWQRLINNNWGFRPKKLSFKLFNIQVRGVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQXXXXGTXXXXXLXFSQAGPQSMSLQARNWLPGPCYRQQRLSXXXXXNNNSXFPWXAASXYHLNGRDSLVNPGPAMASHXDDXXXFFPMHGNLIFGKXXXXXXXXXXXXVMITDEEEIRTTNPVATEQYGTVANNLQXXXXXPTXXXVXHQGALPGMVWQDRDVYLQGPIWA

SEQ ID NO: 1881 - DNA, 1491 bp, Artificial Sequence
  Description of Artificial Sequence: Synthetic polynucleotide
accaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtctaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtga

SEQ ID NO: 1882 - protein, 482 aa, Artificial Sequence
  Description of Artificial Sequence: Synthetic polypeptide
TTSTRTWALPTYNNHLYKQISSQSGASNDNHYFGYSTPWYFDFNRFHCHFSPRDWQRLNNNWGFRPKKLSFKLFNIQRGVTQNDGTTTIANNLTSTQVFTDSEYQLPYVLGSAHQCLPPFPADVFMVPQYGYLTNNGSQAVGRSSFYCLEYFPQMLRTGNNFQFSYTFEDVPHSSYAHSQSLDRLMNPLIDYLYYLNRTQGTTSGTTNQSLLFSQAGPQSMSLQARNWLGPCYRQQRLSKTANDNNNSFPWTAASKYHLNGRDSLVNGPAMASHKDDEEKFFPMHGLIFGKEGTTASNAELDNVMITDEEEIRTTNPVATEQYGTVANNLQSSNTAPTTGTVNHQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 1883 - DNA, 1140 bp, Artificial Sequence
  Description of Artificial Sequence: Synthetic polynucleotide
  misc_feature (636)..(636): n is a, c, g, or t
  misc_feature (665)..(665): n is a, c, g, or t
  misc_feature (1064)..(1064): n is a, c, g, or t
accaccagcaccagaacctgggccctgcccacttacaacaaccatctctacaagcaaatctccagcvvmdcaggagctascaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaargcamcvcnrgcggaacarccrvcmhsmrsvvsctgvngtttagccaggctgggcctcagtctatgtctttgcaggccagaaattggctacctgggccctgctaccggcaacagagactttcaamarycbmcrvcsrsaacaacaacagtrastttccttggmcagcggccagcamatatcatctcaatggccgcgactcgctggtgaatccaggaccagctatggccagtcacrrggacgatrmsgrsaratttttccctatgcacggcaatctaatatttggcaaasaarrcrscrvsrvarvcratrycgmsdwcgrsvrsgtaatgattacggatgaagaagagattcgtaccaccaatcctgtggcaacagagcagtatggaactgtggcaaataacttgcagrvsvvsmrsrvcvvscccacgdhtvvsrnsgtcvmscatcagggggccttacctggcatggtgtggcaagatcgtgacgtctaccttcaaggacctatctgggca

SEQ ID NO: 1884 - protein, 620 aa, Artificial Sequence; identical to SEQ ID NO: 1880
  Description of Artificial Sequence: Synthetic polypeptide
  MOD_RES (263)..(264): Xaa can be any naturally occurring amino acid
  MOD_RES (267)..(267): Xaa can be any naturally occurring amino acid
  MOD_RES (450)..(453): Xaa can be any naturally occurring amino acid
  MOD_RES (456)..(460): Xaa can be any naturally occurring amino acid
  MOD_RES (462)..(462): Xaa can be any naturally occurring amino acid
  MOD_RES (491)..(495): Xaa can be any naturally occurring amino acid
  MOD_RES (500)..(500): Xaa can be any naturally occurring amino acid
  MOD_RES (504)..(504): Xaa can be any naturally occurring amino acid
  MOD_RES (508)..(508): Xaa can be any naturally occurring amino acid
  MOD_RES (528)..(528): Xaa can be any naturally occurring amino acid
  MOD_RES (531)..(533): Xaa can be any naturally occurring amino acid
  MOD_RES (546)..(557): Xaa can be any naturally occurring amino acid
  MOD_RES (586)..(590): Xaa can be any naturally occurring amino acid
  MOD_RES (593)..(595): Xaa can be any naturally occurring amino acid
  MOD_RES (597)..(597): Xaa can be any naturally occurring amino acid

SEQ ID NO: 1885 - protein, 738 aa, Artificial Sequence; identical to SEQ ID NO: 7
  Description of Artificial Sequence: Synthetic polypeptide

SEQ ID NO: 1886 - DNA, 2258 bp, Artificial Sequence
  Description of Artificial Sequence: Synthetic polynucleotide
tcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaattgcttgttaatcaataaaccggttgattcgtttcagttgaactttggtctctgcgaagggcgaattcgttt

SEQ ID NO: 1887 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtatttcttaagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaattctcgtggaccggtgctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggtaccagattcctgactcgtaatctgtaa

(The sequence listing continues in the following parts.)

We claim:

1. An adeno-associated viral (AAV) genome comprising a first inverted terminal repeat (ITR), a promoter operably linked to a nucleic acid comprising a modulatory polynucleotide encoding a sense strand sequence and an antisense strand sequence, and a second ITR; wherein the encoded antisense strand sequence comprises the nucleotide sequence of SEQ ID NO: 918 and the sense strand sequence comprises the nucleotide sequence of SEQ ID NO: 1079; and wherein the AAV viral genome comprises one or more of:
   (i) a first ITR sequence comprising the nucleotide sequence of any one of SEQ ID NOs: 1380 or 1381-1383;
   (ii) a promoter comprising a chicken β-actin (CBA) promoter, a cytomegalovirus (CMV) promoter, a phosphoglycerate kinase 1 (PGK) promoter, an H1 promoter, a T7 promoter, a ubiquitin c (UBC) promoter, a β-glucuronidase (GUSB) promoter, a neuron-specific enolase (NSE) promoter, a synapsin promoter, a methyl-CpG binding protein 2 (MeCP2) promoter, or a glial fibrillary acidic protein (GFAP) promoter;
   (iii) a promoter comprising the nucleotide sequence of any one of SEQ ID NOs: 1410, 1411-1414; or
   (iv) a second ITR sequence comprising the nucleotide sequence of any one of SEQ ID NOs: 1382, 1380, 1381, or 1383.

2. The AAV viral genome of claim 1, wherein the nucleotide sequence encoding the antisense strand sequence comprises the nucleotide sequence of SEQ ID NO: 1335, and the nucleotide sequence encoding the sense strand sequence comprises the nucleotide sequence of SEQ ID NO: 1331.

3. The AAV viral genome of claim 1, wherein:
   (i) the encoded sense strand sequence and the encoded antisense strand sequence comprises a 3' overhang of at least 1 or 2 nucleotide; and/or
   (ii) the encoded antisense strand sequence and/or encoded sense strand sequence independently comprises at least 21, 22, 23 or 24 nucleotides in length.

4. The AAV viral genome of claim 1, wherein the modulatory polynucleotide comprises in 5' to 3' order:
   (i) a 5' flanking region, the sense strand sequence, a loop region, the antisense strand sequence, and a 3' flanking region; or
   (ii) a 5' flanking region, the antisense strand sequence, a loop region, the sense strand sequence, and a 3' flanking region.

5. The AAV viral genome of claim 4, wherein:
   (i) the 5' flanking region comprises the nucleotide sequence of any one of SEQ ID NOs: 1163, 1167, 1161, 1162, or 1164-1166;
   (ii) the loop region comprises the nucleotide sequence of any one of SEQ ID NOs: 1172, 1175, 1169, 1168, 1170, 1171, 1173, or 1174; and/or
   (iii) the 3' flanking region comprises the nucleotide sequence of any one of SEQ ID NOs: 1178, 1182, or 1179-1181.

6. The AAV viral genome of claim 1, wherein the modulatory polynucleotide comprises the nucleotide sequence of SEQ ID NO: 1262.

7. The AAV viral genome of claim 1, wherein:
   (i) the first ITR sequence comprises the nucleotide sequence of any one of SEQ ID NOs: 1380 or 1381-1383;
   (ii) the promoter comprises the nucleotide sequence of any one of SEQ ID NOs: 1410, 1411-1414; and
   (iii) the second ITR sequence comprises the nucleotide sequence of any one of SEQ ID NOs: 1382, 1380, 1381, or 1383.

8. The AAV viral genome of claim 1, which further comprises:
   (i) an enhancer;
   (ii) at least 1 or at least 2 multiple cloning site (MCS);
   (iii) an intron;
   (iv) an exon;
   (v) a filler sequence;
   (vi) a microRNA (miRNA) binding site; and/or
   (vii) a polyadenylation (polyA) signal sequence region.

9. The AAV viral genome of claim 8, wherein:
   (i) the enhancer comprises a CMV enhancer;
   (ii) the enhancer comprises SEQ ID NO: 1408 or 1409;
   (iii) the MCS comprises the nucleotide sequence any one of SEQ ID NOs: 1384-1387 or 1389 or the nucleotide sequence of TCGAG;

(iv) the intron comprises an SV40 intron or a beta-globin intron,
(v) the intron comprises the nucleotide sequence of any one of SEQ ID NOs: 1417-1419;
(vi) the exon comprises a beta-globin exon;
(vii) the exon comprises the nucleotide sequence of SEQ ID NO: 1415 or 1416;
(viii) the polyA signal sequence region comprises a rabbit globin polyadenylation signal sequence region; and/or
(ix) the polyA signal sequence region comprises the nucleotide sequence of any one of SEQ ID NOs: 1420-1423.

10. The AAV viral genome of claim 1, comprising in order:
(i) a 5' inverted terminal repeat (ITR) sequence region, wherein the 5' ITR sequence region comprises the nucleotide sequence of SEQ ID NO: 1380 or 1381;
(ii) an enhancer sequence region, wherein the enhancer sequence region comprises the nucleotide sequence of SEQ ID NO: 1408 or 1409;
(iii) a promoter sequence region, wherein the promoter sequence region comprises the nucleotide sequence of any one of SEQ ID NOs: 1410-1414;
(iv) a first intron sequence region, wherein the first intron sequence comprises the nucleotide sequence of any one of SEQ ID NOs: 1417-1419;
(v) a modulatory polynucleotide sequence region, wherein the modulatory polynucleotide sequence region comprises the nucleotide sequence of SEQ ID NO: 1262;
(vi) a polyadenylation (polyA) signal sequence region, wherein the polyA signal sequence region comprises the nucleotide sequence of any one of SEQ ID NOs: 1420-1423; and
(vii) a 3' ITR sequence region, wherein the 3' ITR sequence region comprises the nucleotide sequence of SEQ ID NO: 1382 or 1383.

11. The AAV viral genome of claim 1, comprising, from 5' to 3':
(i) a 5' inverted terminal repeat (ITR) sequence region comprising the nucleotide sequence of SEQ ID NO: 1380;
(ii) a first multiple cloning site (MCS) sequence region comprising the nucleotide sequence of SEQ ID NO: 1384;
(ii) an enhancer sequence region comprising the nucleotide sequence of SEQ ID NO: 1408;
(iii) a promoter sequence region comprising the nucleotide sequence of SEQ ID NO: 1410;
(iv) an intron sequence region comprising the nucleotide sequence of SEQ ID NO: 1417;
(v) a modulatory polynucleotide sequence region comprising the nucleotide sequence of SEQ ID NO: 1262;
(vi) a second MCS sequence region comprising the nucleotide sequence of TCGAG;
(vii) a polyA signal sequence region comprising the nucleotide sequence of SEQ ID NO: 1420; and
(viii) a 3' ITR sequence region comprising the nucleotide sequence of SEQ ID NO: 1382.

12. An AAV viral particle comprising the AAV viral genome of claim 1, and an AAV capsid protein, wherein the AAV capsid protein comprises an AAV1 capsid protein, an AAV5 capsid protein, or an AAV9 capsid protein.

13. A vector comprising the AAV viral genome claim 1.

14. A cell comprising the AAV viral genome of claim 1, wherein the cell is a mammalian cell, a medium spiny neuron, a cortical neuron, or an astrocyte.

15. A pharmaceutical composition comprising an AAV particle comprising the AAV viral genome of claim 1, and a pharmaceutically acceptable excipient.

16. A method of inhibiting expression of a Huntingtin (HTT) gene, mRNA, and/or protein in a cell, comprising contacting the cell with the AAV viral genome of claim 1.

17. The method of claim 16, wherein the cell is in a subject, and the subject has or has been diagnosed with having Huntington's Disease (HD).

18. A method of treating Huntington's Disease (HD) in a subject, comprising administering to the subject an effective amount of an AAV viral particle comprising the AAV viral genome of claim 1, thereby treating HD in the subject.

19. The method of claim 18, wherein the HD is:
(i) a juvenile form HD in a subject of 2 to 20 years of age;
(ii) an early stage HD;
(iii) a late stage HD;
(iv) a fully penetrant HD, wherein the HTT gene has at least 41 or more CAG repeats;
(v) an incomplete penetrance HD, wherein the HTT gene has 36-40 CAG repeats; or
(vi) an asymptomatic HD.

20. The method of claim 18, wherein administration is intravenous, intracisternal, or both.

21. The method of claim 16, wherein the cell is a mammalian cell, a central nervous system (CNS) cell, a neuron, a medium spiny neuron, a cortical neuron, or an astrocyte.

* * * * *